United States Patent 10,113,176 (ISOLATED POLYNUCLEOTIDES AND POLYPEPTIDES, AND METHODS OF USING SAME FOR INCREASING NITROGEN USE EFFICIENCY, YIELD, GROWTH RATE, VIGOR, BIOMASS, OIL CONTENT, AND/OR ABIOTIC STRESS TOLERANCE) - sequence listing, part 3

SEQ ID NO: 3630 - DNA, 7063 bp, Sorghum bicolor
ttcagattcagggaggggaaggcaccgcacaaacccccctcactcccgccggccgccgcgacggccgacgagtcctccgggagagcgcgaggaggacccttcctccacccgccgccgcacgcccacaaagcggctcccaccatgtccaacctcggcggcgccgaggcgcacgcgcgcttcaagcagtacgactacggcgccaactccagcctcgtgctcaccaccgactcccgcccgcgcgacacccacgagcccacaggcgagcccgagacgctccggggcaggatcgacccgaggtccttcggcgaccgcgccgtccacaacaagccgcccgagctcgacgagaagctctccaaggcgcgatcaaaaaagtccaagcgccgggacgacgcgcccgacctcccccgccgcgacgccaagcgcaggcgccgcgccgcctccgtacacgaggtctccgtcctctctctcaccgaagacgccgtctacaagccccagaccaaggagacgcgcgccgcatacgaggccctgctcagcctcatccagcaccagctcggcggccagcccctcgacgtcctcgctggggccgccgacgaggtgctcgccacgctcaagaacgacaaggtcaagaaccctgacaagaagaaggtgatcgagcagctgctcaaccctatctccagccagctctttgaccagctcgtctccatcggcaagctcatcaccgacttccatgatgccggtgcaccttctgccgacgccatggacactaccctggatgatgatgttggggttgctgtcgagtttgaggaagatgaagccgaggagagtgattttgatcaggtgcaagatgacctggatgaggatgatgaagatgatgcagctgagttgaatggtcctggaggtatgcagatgggcagtgagttagacgacgacaacgacatgcacaacgccaaccaggggctggccgtcaatgttcaggacatcgatgcttactggctccagaggaagatatcccaggcatatggggatggggtcattgatgcccagcagggccagaagcttgccgaggatattttgaagatcattgctgagggcgacgacagagacatcgagaattgcctcctcatgctcttggactttgataagtttgatctcatcaagttgctgctacgcaaccgtctcaagattgtgtggtgtacccgcttagccagggccgaagatcaggaacagaggaagaagatagaggaagagatggcaagtgacccaagcttggctctgatattggagcagctacatgcaaccagagcatccgcaaaggagaggcagaagaacctggagaaaagcatcagggatgaggctaagaggctcctcaacaatgatgctgccgccggcgctgatggtgccagggaccgcagggcagccgagcgggacatggagagtggaatgctgaaaggacagaggaagctgcttgatctcaagagcctctcgttccagcagggtggtctctttatggctaacaagaaatgtgaacttcctactgggtcctttagaacctctcataagggatatgaggaggttcatgtgccagcactgaaggctatgccctatgaaacaggggagaagattgtcaagatatgtgatatgccagagtttgcacgggcagctttcgaagggatgacacagctgaacagagttcagagcagggtctatgatactgctcttttgaaaccagacaatatccttctctgtgctccaactggtgctggcaaaacaaacgtggctgtgcttaccatccttcaacagattggtatgcatatgcaggatggagagtttgacaataccaagtacaaaattgtctatgtggccccaatgaaagcattggtcgctgaagtcgttgggaacttgtcgaagcgtctggcaggttacaacgttactgtcaaggagctcagtggagatcagaacttgaccaagcaacagattgatgaaacacaggttattgtcacgacacctgagaaatgggatattgtaaccaggaaatcaggggacagaacctatacccaaatggtgaagctgttaatcattgatgagatccatctgctacatgataacagagggcctgttctggaaagtattgttgctaggactgtcaggcagattgagacaaccaaggagcatattcgtctggttgggctctctgcgactctaccaaactacgaagatgttgcactattcttgcgcgttcccaaagaaagcctcttctactttgacaacagttaccgaccttgccctcttgctcagcaatacattgggattacagtgaggaagccagtacagaggatgccattgatgaatgagatctgttatgagaaggttatggccgctgctggtaagcatcaagtgctcatatttgtacactcgaggaaggagacagcaataactgccaaagccatcagagacatggcgttggcaaatgacacagtcagccgctttctgaagaacgatagtgtaagccaagagatccttggcactaacgctgaacttgtcaaaagcaatgatcttaaagacctcctgccatatgggtttgctattcatcatgctggtatggcaagggttgaccgtgagcttgttgaggcactttatgctgacaagcacattcaagtacttgtatccactgctacccttgcatggggtgtcaatttgcctgcacatactgttattataaagggtacacagatttacaacccagaggaaggtgattggacagaactaagccctctggatgttatgcagatgcttggtcgtgcaggaaggcctcagtatgatacacatggagagggaataatcttgactagccacagtgaattgcggttctacctgtctcttatgaaccagcagctgcctattgagagtcagttcatatccaaattggctgatcaattgaatgcagagattgttctggggactattcagaatgctcgtgaagcatgctcgtggcttggctatacttacctctatatccggatgctccgaaatccaacattgtatggtttgccagcagatatcttggagagtgacaaaacacttgatgaaatgagagctgatttggtacattccgctgcaaatctactggataagaataatctgataaagtatgacaggaaaacaggatactttcaagttactgacctgggaaggattgccagttattactacattagtcatggaacaatctcaacatacaatgaatacctgaaacctacaatgggtgatatcgagctgtgtcgactgttttctctgagtgaagaatttaagtatgtaggtgtcaggctagatgagaaaatggaactggcaaagcttttggaccgtgtgccaattcctgtgaaagagagcttggacgaacccagtgcaaagataaatgttctgctgcaagcatatatttctaggttgaaactggaaggacattctcttagttctgatatggtctacatccaacagagtgctggacgtctcctacgagcactatttgagattgttttgaagaggggatgggctcaactagcagagaaagcgctgaatctttgcaggatggttgataaacaaatgtggagtgtccagactcccttgcggcaatttactggaattccaaaggcgatcttaatgaaactggagaaaaaggagttggcttgggagagatactatgatctgtcctcacaagaaattggtgaactaatccgctatcccaagatggggaggcagctgcacaagtgcatccaccagttaccaaagttgaatctttcagctcatgtccagcccatcactcgtacagttttgggctttgaactgacaattacacctgatttccagtgggatgataaggtacatggatatgtggagcccttttgggttattgttgaggataatgatggcgagtacattcttcacactgaatatttcatgcttaagaaacagtatgttgatgaagatcatactttgaacttcacagtgccaacatatgagccactgccgcctcaatatttcatacgtgttgtgtctgacaagtggcttggttctctgacaattctccctgtctgctttaggcacttgattctaccagaaaaatatgctccgccaactgaattgcttgatctgcagcctctacctgttagtgcattgaggaatgcaagatatgagggcctctatagtgcctttaagcatttcaatcccatccagactcaggtattcactgtcttgtataacaccgatgacagcgtgttggtcgctgcaccaacgggcagtgggaagacgatatgtgctgagtttgctatactaaggaaccaccagagggcagtgtccggtgagagcaacatgcgggtcgtttatatagctcccattgaagctctcacaaaagaaagatacagggactgggaacggaaatttggagaatttgccaaggtagttgagctcactggtgaaaccgcagctgatttgaagcttctggataaaggagaaatcataatcagtactcctgaaaagtgggatgcactgtctcgccggtggaaacagcgaaagcacatccaacaggtcagcttattcatagttgatgaacttcatctacttgggtctgataagggacatgttttggaagtcattgtatctaggatgaggcgtatttcaagtcatactggcagtaacatacggatcgtagcactttcagcttcacttgctaatgctaaggatctcggtgaatggattggtgctacctctcatggcctcttcaacttccctccagcagtgagacctgtgccattggaaatttacattcagggtgtggatatagcaaactttgaggcaaggatgcaagcaatgacaaagcccacctacactgccatcacacagcatgcaaagaacagtaaacctgccctggtgtatgtaccgacaaggaagcatgcaaggttgactgcattggacttgtgtgcatactctagtgttgacggtggtggaactctgtttctccttgggtcagaagatgagatggatactttcacccgaggtgttgaagaagagacacttaagaatacacttaaatgtggtgtaggatatgtgcatgagggtctaagtgaacttgatcaagaacttgtaacccagctgttccttgctgggaggatccaagtgtgtgttgcgagcagcacaatgtgttggggaagaccattgcctgctcatttggttgttgtcatggggacccagtattatgatggccgtgagaatgctcacactgattatccaattacagatcttcttcaaatgatgggtcatgccagcagaccacttaaagacaactcggggaaatgtgttatattgtgtcacgcacctcgcaaagagtactacaagaagttcctttttgaggccttccctgttgagagcaatcttcaccatttcttgcatgatcatatgaatgctgaggtggtggttggtgttgtagagaataagcaagatgccgtggattatcttacttggactttcatgtatcggcggctgacaaagaatcctaacttctacaatctccagggtgtaactcacaggcatctttcagatcatctttctgagctagttgaggctttcctgaatgatcttgaatcaagcaagtgtgtggctatagaggaggacatgtacctgaagcccctgaaccttggccttattgcttcatactactatgttagctacacgactattgagcgtttcagctctatgctgacccagaagactaagatgaaaggactcctagagattctagcatctgcttcagaatatgcagagcttctgggtcgtccgggtgaggaagaattcattgagaggcttgttcgccaccagaggttctctatcgacaagcctaagtatggtgatccacatgtgaaggccaatgctctgctgcaagcccatttttcaaggcacacagtggtcggaaacctggcagctgatcagcgtgagattcttttttctgcccataggttgctccaggcaatggttgatgttatatccagcaatggttggcttagcgttgctcttagtgcaatggagtcgagtcaaatggtgacacaaggcatgtgggatcgggattctgtgctgcttcaagttccacacttcacgaaagacatggcccggaggtgccaggaaaatgaagcgaagcccattgagagtatctttgatcttgctgaggtgggtgttgatgagatgcgggatcttttacagctatcaaactctcagctgcaggacatcattgaattcttcaagcggttccctaatgttgatatgacctatgtggtccgtgcgggtgacgatataagcactggtgacaatgtaaccgtgcaggtaacgctggagcgcgacatgactaacttgccatctgaggttggttcagtccatgcgccaaggttccccaagcccaaggaagaaggctggtggctggtgatcggtgacagctccacaaaccagttactggccatcaaaagagtggcactccagaagagggcgagagtgaaacttgagttctctgctcctccagaagcagggagaaaaaattacatgatttacttgatgtcagactcttacttgggctgtgaccaggagtatgagttcaccgttgatgtcaaggatgctggtggggattgatgatgaagactgacactgtgtcgcatagaagcagttgacttggagtgtgtattgtaggcttgtagcacgttattagtgtcttggaacattctatgtctgcaacctctgaacttgtggaagctgtagcttattttggatgttaataactagtgcaccttgggagttgctgccttatcctgttatggtattattctatggatcatgcaggattatacttgagccacacagtatttgtttatcaacttgttgcttccataagcttgctgctcctgtaatgttgatttagtgtcgtgcagtagaaaatgttaggtataacctgttgatgcaccaacggtgttggtgttttaatgcagtaggaaatgttataacctgttgtccgtgcttgtctaaaatctttggg

SEQ ID NO: 3631 - DNA, 7038 bp, Oryza sativa
aaaatccagtccctcccatcccatcgccgccttttccttttcctccaaatccaacctcctcttctcccccttctccggcgcggcggcggcggtatcaccggaggcgccgaccctccctcggctcgccaaaagccatggcgaacctgggcggcggcgccgaggcgcacgcgcgcttcaagcagtacgagtaccgcgccaactccagcctcgtcctcaccaccgactcgcgcccccgcgacacccacgagcccaccggcgagcccgagacgctctggggcaggatcgaccccaggagcttcggcgaccgcgccgtccaggccaagccccccgagctcgaggagaagctcaccaagtcccgcaagaagaaggccgccgccgctgaccccgacgacctccaccgccgcgacgccaagcgcaggcgccgcgccgcagccgcccagcgtgaggtcagcgtcctctcgctcaccgacgacgtcgtctacaagccccagaccaaggagacgcgcgccgcctacgaggccctgctcagcgtcatccagcagcagttcggcggacagccgctcgacgtgctcggcggcgctgccgacgaggtgctcgccgtcctcaagaatgacaagatcaagagccctgacaagaagaaggagatcgagaagctcctcaaccctatctccaaccagatgttcgaccagatcgtctccatagggaagctcatcacggatttccatgatgcctcggctggtgattcagctgctgcgccatctggtgatggcatggacacagcgctggatgatgacatcggcgttgctgttgaatttgaagagaacgaagatgacgaggagagcgatttcgatcaggtgcaagatgatttggatgaagatgaagatgatgacttgcctgagtcgaatgcccctggtgctatgcaaatgggtggcgagttagatgatgatgatatgcagaactccaacgaggggctgaccataaatgtacaagacattgatgcttactggcttcagaggaaggtctcgcaagcatacgaagatattgatccgcagcacagtcagaagcttgctgaggagatcttgaagataattgctgagggtgatgacagagatgtcgagaatcggcttgtcatgctgttggactatgaaaagtttgatctcattaaactgctactacgcaaccgactcaagattgtttggtgtacccgtttagcaagggctgaagatcaggaacagcggaagaagattgaggaagatatgatgggtaacccaactttaactccgatattggagcagctacatgcaacgagggcatctgcaaaggagaggcagaagaatctagagaaaagtatcagggatgaggccaagaggcttactaaaagcgaaaacactggcattgatggtgcgagggatcgtagggcagttgaccgggatatggagagtggatggttgaaaggccagaggcagctgcttgatcttgacagcctgtccttccaccaaggtggtctcttgatggccaacaagaaatgtgagcttcctccaggatcattcagaacccctcataaggggtatgaggaagtccatgtgccggcgctaaaagctaagccatatgaaactggagagaagattgtcaagatatctgatatgccagagtgggctcaaccagcttttgctaagatgacacagctgaacagggttcagagcaaggtttatgagactgcccttttcaaaccagataatattctcctctgtgctccaacaggtgctgggaaaaccaatgtggctgtgctcacaatccttcagcagattgggttgcatatgaaggatggagtgtttgacaataccaagtacaaaattgtctatgtggccccaatgaaagctttggttgccgaagttgttggaaatttgtcggctcggctgagtgcatatggtattactgtaagagagctcagtggagaccagaacctgaccaaacagcagattgatgaaacacagataattgtcaccacacctgagaaatgggacattgtcacaagaaaatcaggtgacagaacctatactcaaatggtaaagcttctaatcattgatgagatccatctacttcatgacaacagagggcctgttctggagagcattgtttctagaactgtccggcagattgagacgaccaaagaacatatccgtctagttggtctctcagcaactcttccgaactatgaagatgtcgcggttttcctgcgtgttcgctctgatggcctcttccatttcgataacagctacagaccttgcccccttgctcagcaatacattgggatcactgtgaggaagccactacagaggtttcagctgatgaatgagatttgctacgagaaggttatggcatctgctggaaagcatcaagtgcttatattcgtgcactcgaggaaggagacagcgaaaactgcccgtgccatcagagatactgcattggctaatgacacgttaaaccgcttcttgaaggatgatagtgcaagccaagagattcttgggagtcaggcagaactagtaaaaagcagtgaccttaaagaccttttgccttatgggtttgctattcatcatgctgggttggcaagggtagaccgtgagcttgtagaggagctttttgccgataagcatatacaggtccttgtctcaacagccacccttgcatggggtgtcaatttgcctgcacacactgttataataaagggtacccagatttacaatcctgaaaagggtgcgtggacagagctgagtcctctagatgtcatgcagatgcttggccgtgctggcaggccacagtatgatacacatggagagggaataatcctaactggccacagtgaattgcaatattacctgtctctaatgaatcaacaactgcctattgagagtcagttcatatccagattggctgatcaattaaatgcagagattgttcttgggactattcagaatgctcgggaggcatgctcatggcttggctacacctacctctacatccggatgctccggaatccaacattgtatggtctaccggcagatatcatggagactgataaaacactagatgaaaggagagctgacttggtgcactctgctgcaaatctgctcgataggaacaatttgataaagtatgacaggaaaacaggatacttccaggttactgacctaggaaggattgctagttattactatattagccacgggactatttcaacttacaatgagtacctgaagcctacaatgggtgatattgagctatgtcggctcttttcactcagtgaagaattcaagtatgtcagtgttagacaagatgagaaaatggagctggctaagcttttggatcgtgtgcctattcctgtgaaagaaagcttggaggagcccagtgcaaagatcaatgttctgctgcaagcatatatttctaggctgaaattggagggtctttcgcttagctccgatatggtctacatcagacagagtgctggccgtctcttacgagcgttgtttgagatagttctgaagagaggatgggcccaactagcagagaaggctttgaatctttgtaagatgatagataagcagatgtggaatgtccaaactcccctgcgccaattccctggtattccgaaggaaatcctaatgaaactggagaaaaaagaattggcttgggagaggtactacgacctatcatctcaggaaattggtgaactaattcggttcccgaagatgggcaggcaactgcacaagtgcatccaccagttaccaaagttgaatctttcagcccatgttcagccaattactcgtacggttttgggttttgagttgactataactcctgatttccaatgggatgataaggtacatggatatgtggagcctttctgggttattgttgaggacaacgatggcgagaacattcttcaccatgagtacttcatggttaagaaacaatacgtagatgaagatcatacactcaacttcacagtgccaatatacgagccactgccccctcaatactttattcgtgttgtatctgataagtggcttggttctcagacaattcttcctgtctgttttaggcacttaattcttccagaaaaatatgctccgccaactgaattgcttgatctgcagccactgcctgttactgcattgagaaatgcacgatacgaaggcctttatagtgccttcaaacatttcaacccaatccagactcaagtgttcactgttctgtacaacactgatgacagtgttttggttgctgcgccaacaggcagtggaaagaccatctgtgcagagtttgctatactaagaaaccatcagaaggctgtatctggtgagagcaacatgcgagttgtgtatattgctcctattgaagcccttgcaaaagaaaggtacagggattgggagcagaaatttggagaatttgctcgggtagttgagctaacaggtgaaactgcagctgacttgaagcttctggataaaggggagattataattagtactcctgagaagtgggatgcactctctcgccggtggaaacagcggaaacaagtccaacaggtcagcctattcattgttgatgagcttcatctgattggatctgaaaagggacatgttctggaagtcatcgtctctaggatgaggcgtattgcaagtcatatcggcagtaacatccggattgtggctctttcagcttcacttgcaaatgctaaagatctcggagaatggattggtgctacctctcatggccttttcaactttcctccagctgtccggccggtgccattagaaatacacattcagggtgtggatatagcaaattttgaggcaaggatgcaggcaatgacgaagccgacatacactgctattacccaacatgcaaagaatggtaaacctgccctggtgtttgtgcctacacggaagcatgcaaggttgactgcattggacttgtgtgcatactcgagtgctgagggtggtggaacacctttccttcttggttcagaagatgagatggatgctttcactggtggtatcagtgatgaaacacttaaatatactctgaaatgtggtgtaggctacttgcatgaaggtttaagtgatctggaacaggaagttgtaacgcagctgtttctcggtgggaggatccaagtgtgtgttgcgagtagcactgtgtgctggggaagatcattgcctgcccatctggtggttgtgatgggaacccagtattatgatggccgggagaatgctcatactgattatccaatcactgatctactccaaatgatgggtcatgctagcaggcctcttcaagataactcagggaaatgtgttatattgtgtcatgcgcctcgcaaggaatactacaagaagttcctttttgaggccttccctgttgagagccatcttcaccacttcttgcatgatcatatgaacgctgaggtggtggttggtgtcatagaaaacaagcaagatgctgtggattaccttacttggaccttcatgtacaggcggctgaccaagaaccctaactactacaatctgcagggcgtgagccacaggcatttgtcggaccatttatctgagttggttgagactgtattgaatgacctagaatcaagcaagtgtgtggctatagaggaggatatgtacctgaagcccctcaaccttggtctgattgcttcgtactactacattagctacacaactattgagaggttcagttcaatgctaactcaaaagactaagatgaaagggctcctggagattctagcctctgcttcagaatatgctgagcttcccagtcgccctggtgaggaggatttcattgagaagcttgttcgccaccagagattttccatcgagaagcccaagtatggtgatccacatgtcaaggctaacgcactgctgcaagctcatttttcaaggcacactatcttagggaacctggcagccgaccagcgggagatactcctttctgctcatagattgctccaggcaatggttgatgttatctccagcaatggatggcttacgcttgctcttaatgcaatggagctgagtcaaatggtgacacaaggcatgtgggatcgtgattctgttcttttacaacttccacatttcaccaaggagttggcacggagatgtcaggagaatgaagggaggcccattgagagcatctttgatctggctgagatgagcatcgatgagatgcgggatctgttgcagcaatcaaaccctcagctgcaggatatcattgaattcttcaagcgtttccccaatgtcgatatggcttacgaagttcgcgagggtgatgatatcagggctggtgacaatgtaactgtacaggtgaccctggagcgtgacatgacgaacttgccttctgaggtggggccagttcatgcccccaggtacccaaagcccaaggaagaaggctggtggctggtaattggtgatagctctaccaatcagttgcttgcaatcaagagggttgcacttcagaagagggctcgagtgaagcttgagttcaccgctgcttcagaagctgggagaaaggagtacatgatctacctgatgtccgattcttatctgggctgcgatcaggagtacgagttcaccgtcgatgtcatggatgctggaggggattgatcccaaggccagaaagaggatgaaagctttgcccagcccccaggtgtgtatggagctgggtggttgcttgtacgctcgtagcaattcctaatgtcctatccacacttgtatgtgtttgtactcgtttttatctttagccattttcttagtgtaactgatgctcacctctgctgctacctgtggtcatctttggggatctttattagctagcctatggctgtgcttcttgtgatcatccttcttattgtgtttttgtcttcctgtttcatcaaagcaagtcactaacgttttgattcttatctatatcattttatcatgccgttggtttggcccgtattaattgttacatctcatatgatactctgctcat

SEQ ID NO: 3632 - DNA, 6904 bp, Oryza sativa
atggcgaacctgggcggcggcgccgaggcgcacgcgcgcttcaagcagtacgagtaccgcgccaactccagcctcgtcctcaccaccgactcgcgcccccgcgacacccacgagcccaccggcgagcccgagacgctctggggcaggatcgaccccaggagcttcggcgaccgcgccgtccaggccaagccccccgagctcgaggagaagctcaccaagtcccgcaagaagaaggccgccgccgctgaccccgacgacctccaccgccgcgacgccaagcgcaggcgccgcgccgcagccgcccagcgtgaggtcagcgtcctctcgctcaccgacgacgtcgtctacaagccccagaccaaggagacgcgcgccgcctacgaggccctgctcagcgtcatccagcagcagttcggcggacagccgctcgacgtgctcggcggcgctgccgacgaggtgctcgccgtcctcaagaatgacaagatcaagagccctgacaagaagaaggagatcgagaagctcctcaaccctatctccaaccagatgttcgaccagatcgtctccatagggaagctcatcacggatttccatgatgcctcggctggtgattcagctgctgcgccatctggtgatggcatggacacagcgctggatgatgacatcggcgttgctgttgaatttgaagagaacgaagatgacgaggagagcgatttcgatcaggtgcaagatgatttggatgaagatgaagatgatgacttgcctgagtcgaatgcccctggtgctatgcaaatgggtggcgagttagatgatgatgatatgcagaactccaacgaggggctgaccataaatgtacaagacattgatgcttactggcttcagaggaaggtctcgcaagcatacgaagatattgatccgcagcacagtcagaagcttgctgaggagatcttgaagataattgctgagggtgatgacagagatgtcgagaatcggcttgtcatgctgttggactatgaaaagtttgatctcattaaactgctactacgcaaccgactcaagattgtttggtgtacccgtttagcaagggctgaagatcaggaacagcggaagaagattgaggaagatatgatgggtaacccaactttaactccgatattggagcagctacatgcaacgagggcatctgcaaaggagaggcagaagaatctagagaaaagtatcagggatgaggccaagaggcttactaaaagcgaaaacactggcattgatggtgcgagggatcgtagggcagttgaccgggatatggagagtggatggttgaaaggccagaggcagctgcttgatcttgacagcctgtccttccaccaaggtggtctcttgatggccaacaagaaatgtgagcttcctccaggatcattcagaacccctcataaggggtatgaggaagtccatgtgccggcgctaaaagctaagccatatgaaactggagagaagattgtcaagatatctgatatgccagagtgggctcaaccagcttttgctaagatgacacagctgaacagggttcagagcaaggtttatgagactgcccttttcaaaccagataatattctcctctgtgctccaacaggtgctgggaaaaccaatgtggctgtgctcacaatccttcagcagattgggttgcatatgaaggatggagtgtttgacaataccaagtacaaaattgtctatgtggccccaatgaaagctttggttgccgaagttgttggaaatttgtcggctcggctgagtgcatatggtattactgtaagagagctcagtggagaccagaacctgaccaaacagcagattgatgaaacacagataattgtcaccacacctgagaaatgggacattgtcacaagaaaatcaggtgacagaacctatactcaaatggtaaagcttctaatcattgatgagatccatctacttcatgacaacagagggcctgttctggagagcattgtttctagaactgtccggcagattgagacgaccaaagaacatatccgtctagttggtctctcagcaactcttccgaactatgaagatgtcgcggttttcctgcgtgttcgctctgatggcctcttccatttcgataacagctacagaccttgcccccttgctcagcaatacattgggatcactgtgaggaagccactacagaggtttcagctgatgaatgagatttgctacgagaaggttatggcatctgctggaaagcatcaagtgcttatattcgtgcactcgaggaaggagacagcgaaaactgcccgtgccatcagagatactgcattggctaatgacacgttaaaccgcttcttgaaggatgatagtgcaagccaagagattcttgggagtcaggcagaactagtaaaaagcagtgaccttaaagaccttttgccttatgggtttgctattcatcatgctgggttggcaagggtagaccgtgagcttgtagaggagctttttgccgataagcatatacaggtccttgtctcaacagccacccttgcatggggtgtcaatttgcctgcacacactgttataataaagggtacccagatttacaatcctgaaaagggtgcgtggacagagctgagtcctctagatgtcatgcagatgcttggccgtgctggcaggccacagtatgatacacatggagagggaataatcctaactggccacagtgaattgcaatattacctgtctctaatgaatcaacaactgcctattgagagtcagttcatatccagattggctgatcaattaaatgcagagattgttcttgggactattcagaatgctcgggaggcatgctcatggcttggctacacctacctctacatccggatgctccggaatccaacattgtatggtctaccggcagatatcatggagactgataaaacactagatgaaaggagagctgacttggtgcactctgctgcaaatctgctcgataggaacaatttgataaagtatgacaggaaaacaggatacttccaggttactgacctaggaaggattgctagttattactatattagccacgggactatttcaacttacaatgagtacctgaagcctacaatgggtgatattgagctatgtcggctcttttcactcagtgaagaattcaagtatgtcagtgttagacaagatgagaaaatggagctggctaagcttttggatcgtgtgcctattcctgtgaaagaaagcttggaggagcccagtgcaaagatcaatgttctgctgcaagcatatatttctaggctgaaattggagggtctttcgcttagctccgatatggtctacatcagacagagtgctggccgtctcttacgagcgttgtttgagatagttctgaagagaggatgggcccaactagcagagaaggctttgaatctttgtaagatgatagataagcagatgtggaatgtccaaactcccctgcgccaattccctggtattccgaaggaaatcctaatgaaactggagaaaaaagaattggcttgggagaggtactacgacctatcatctcaggaaattggtgaactaattcggttcccgaagatgggcaggcaactgcacaagtgcatccaccagttaccaaagttgaatctttcagcccatgttcagccaattactcgtacggttttgggttttgagttgactataactcctgatttccaatgggatgataaggtacatggatatgtggagcctttctgggttattgttgaggacaacgatggcgagaacattcttcaccatgagtacttcatggttaagaaacaatacgtagatgaagatcatacactcaacttcacagtgccaatatacgagccactgccccctcaatactttattcgtgttgtatctgataagtggcttggttctcagacaattcttcctgtctgttttaggcacttaattcttccagaaaaatatgctccgccaactgaattgcttgatctgcagccactgcctgttactgcattgagaaatgcacgatacgaaggcctttatagtgccttcaaacatttcaacccaatccagactcaagtgttcactgttctgtacaacactgatgacagtgttttggttgctgcgccaacaggcagtggaaagaccatctgtgcagagtttgctatactaagaaaccatcagaaggctgtatctggtgagagcaacatgcgagttgtgtatattgctcctattgaagcccttgcaaaagaaaggtacagggattgggagcagaaatttggagaatttgctcgggtagttgagctaacaggtgaaactgcagctgacttgaagcttctggataaaggggagattataattagtactcctgagaagtgggatgcactctctcgccggtggaaacagcggaaacaagtccaacaggtcagcctattcattgttgatgagcttcatctgattggatctgaaaagggacatgttctggaagtcatcgtctctaggatgaggcgtattgcaagtcatatcggcagtaacatccggattgtggctctttcagcttcacttgcaaatgctaaagatctcggagaatggattggtgctacctctcatggccttttcaactttcctccagctgtccggccggtgccattagaaatacacattcagggtgtggatatagcaaattttgaggcaaggatgcaggcaatgacgaagccgacatacactgctattacccaacatgcaaagaatggtaaacctgccctggtgtttgtgcctacacggaagcatgcaaggttgactgcattggacttgtgtgcatactcgagtgctgagggtggtggaacacctttccttcttggttcagaagatgagatggatgctttcactggtggtatcagtgatgaaacacttaaatatactctgaaatgtggtgtaggctacttgcatgaaggtttaagtgatctggaacaggaagttgtaacgcagctgtttctcggtgggaggatccaagtgtgtgttgcgagtagcactgtgtgctggggaagatcattgcctgcccatctggtggttgtgatgggaacccagtattatgatggccgggagaatgctcatactgattatccaatcactgatctactccaaatgatgggtcatgctagcaggcctcttcaagataactcagggaaatgtgttatattgtgtcatgcgcctcgcaaggaatactacaagaagttcctttttgaggccttccctgttgagagccatcttcaccacttcttgcatgatcatatgaacgctgaggtggtggttggtgtcatagaaaacaagcaagatgctgtggattaccttacttggaccttcatgtacaggcggctgaccaagaaccctaactactacaatctgcagggcgtgagccacaggcatttgtcggaccatttatctgagttggttgagactgtattgaatgacctagaatcaagcaagtgtgtggctatagaggaggatatgtacctgaagcccctcaaccttggtctgattgcttcgtactactacattagctacacaactattgagaggttcagttcaatgctaactcaaaagactaagatgaaagggctcctggagattctagcctctgcttcagaatatgctgagcttcccagtcgccctggtgaggaggatttcattgagaagcttgttcgccaccagagattttccatcgagaagcccaagtatggtgatccacatgtcaaggctaacgcactgctgcaagctcatttttcaaggcacactatcttagggaacctggcagccgaccagcgggagatactcctttctgctcatagattgctccaggcaatggttgatgttatctccagcaatggatggcttacgcttgctcttaatgcaatggagctgagtcaaatggtgacacaaggcatgtgggatcgtgattctgttcttttacaacttccacatttcaccaaggagttggcacggagatgtcaggagaatgaagggaggcccattgagagcatctttgatctggctgagatgagcatcgatgagatgcgggatctgttgcagcaatcaaaccctcagctgcaggatatcattgaattcttcaagcgtttccccaatgtcgatatggcttacgaagttcgcgagggtgatgatatcagggctggtgacaatgtaactgtacaggtgaccctggagcgtgacatgacgaacttgccttctgaggtggggccagttcatgcccccaggtacccaaagcccaaggaagaaggctggtggctggtaattggtgatagctctaccaatcagttgcttgcaatcaagagggttgcacttcagaagagggctcgagtgaagcttgagttcaccgctgcttcagaagctgggagaaaggagtacatgatctacctgatgtccgattcttatctgggctgcgatcaggagtacgagttcaccgtcgatgtcatggatgctggaggggattgatcccaaggccagaaagaggatgaaagctttgcccagcccccaggtgtgtatggagctgggtggttgcttgtacgctcgtagcaattcctaatgtcctatccacacttgtatgtgtttgtactcgtttttatctttagccattttcttagtgtaactgatgctcacctctgctgctacctgtggtcatctttggggatctttattagctagcctatggctgtgcttcttgtgatcatccttcttattgtgtttttgtcttcctgtttcatcaaagcaagtcactaacgttttgattcttatctatatcattttatcatgccgttggtttggcccgtattaattgttacatctcatatgatactctgctcat

SEQ ID NO: 3633 - DNA, 7064 bp, Hordeum vulgare
ccccgccgcatcttctctccccccaaatccaccccccttctcccccgtctccgacgccgacgacgccgccgcccccaccacccgagccggcgggagccgcgcccgctagctccgcccgccggccgacccacccacaggtaacaacagccagcacgcccctccctcgctcccctcctcagaaccccagccgcttccaaaaccctagccgccgcctgaccgctccccctcctcctccttgaccccgcagcggcgggatggcgaacctgggaggcggcgcggaggcgcacgcgcggttcaagcagtacgagtaccgcgccaactcgagcctggtgctcaccaccgactcgcgcccgcgggacacgcacgagcccacgggcgagcccgagacgctctggggccggatcgacaagaggagcttcggggaccgcgccgtgcaggccaagccccccgagctcgaggaccgcctcaccaagtcccgcaagaagaaggagcgcgacgcggcctccgccgacgccgacgccgaccagccccgcaagcgcaggcgccgctccgccgccgcccagcgcgaggagagcgtgctctccctcgccgacgacgtcgtctacaagccccagaccaaggagacgcgcgccgcctacgaggccatgctcagcgtcatccagcagcagtttggcggccagccgctcgacgtgctcggcggggctgccgatgaggtgctcgccgtcctcaagaacgacaagatcaagaaccctgacaagaagaaggagatcgagaagctgcttaaccccatctccagcgccatgttcgaccagttcgtctccatcgggaagctcatcacggatttccacgacgccagcgaccctgctgccgtaccttctggtgatggtggggacgctaccatggatgatgatatcggagttgctgttgagttcgaggaggatgaagatgacgaggaaagtgattttgatcaggtgcaagatgatttggatgacgatgatgatgatgtggctgagttgaaccgtcctggaggtatgcagatgggtggcgagttggatgacgatgatatgcagaactccaacgaggggctcaacataaatgtgcaggacattgacgcttactggctgcagaggaagataacacaagcatatgaagatattgatccccagcagagccagaagctagccgaggagatattgaagataattgctgtgggtgatgacagagatgtagagaatcgccttgtcatggagttggactatgagaaattcgatctcattaaactggtattgcgcaaccggttcaagatagtctggtgtacccgcttagccagggctgaagatcaggaagagcggaagaagatagaggaagagatgatggatgacccaagcttagccccaatattggagcagctacatgcaacgagagcctctgcaaaggagaggcagaaaaacttggagaaaagtatcagggatgaggccaagaggcttcttaacaatgacagtgctggcactgatggtccaagggagcgtcgggcagttgagcgggatacagagagtggatggctaaaaggccagaggcagctgcttgatcttgatagcctctccttccaccaaggtggtctcttgatggccaacaagaaatgtgaacttcccgagggatcgttcagaacccctcataaggggtatgaggaagtccatgtgccagcgttgaaacctaggccatatggaactggagagaagattgtgaagatatctgatatcccagggtgggcacaaccggcttttgctggaatgcagcaactgaacagggtccagagcaaggtttatgatactgccctgttcaaaccagacaacatccttctctgtgctccaactggtgctggtaaaaccaatgtggctgtgcttacaattcttcaccagataggtttgcatatgaaggatggtgagtttgataatagcaagtacaaaattgtctatgtggccccaatgaaagctctggttgctgaagttgttggaaacttgtcggcacggcttaaagacttcaatgttaatgttagggagctcagtggagaccagaacctgacaaaacaacagattgatgatacacagatcattgtcaccacacctgagaagtgggatattgtcacgaggaaatctggggacagaacatacactcaaatggtaaagcttctgatcatcgatgagatccatctgcttcatgacaacagagggcctgtcctggagagtattgtgtctagaacagtacggcagattgagacgaccaaggaacatattcgcctagttggcctctccgcaactcttccaaactatgaagatgttgctgtattcctgcgtgttcgctctgagggtctcttccattttgacaacagttaccggccttgccctcttgctcagcagtacattgggatcactgtgaggaagccactgcagaggtttcagttgatgaatgagatctgttatgagaaagtgatggcttctgctggtaagcatcaagtgcttatttttgtgcactccaggaaggagacatcgaaaactgctcgagcaatccgagacactgccttggcgaatgatacattgactcgctttctgaaggatgagagtgcaagccaggagatccttggcagtcatacagatattgtcaaaagcagtgatcttaaagaccttttgccgtatgggtttgctatacatcatgctgggatggcaagggtagaccgtgaacttgttgaggaactttttgctgataagcatatacaggttcttgtttcgacagccacccttgcatggggtgtcaacttgcctgcacatactgttattataaagggcacacagatttataatccggaaaaaggtgcttggacagaattaagtcctctggatgtcatgcagatgcttggtcgtgcaggtaggcctcagtatgacacacacggagagggaataatcttaactggccacagtgaattgcaatactacctctcccttatgaatcaacagctgcctattgagagtcagttcatatccaagttggcagatcagttaaatgcagagattgttctgggtactattcagaatgctcgggaagcatgctcttggcttggctacacttatctctacatccggatgctccggaatccaacactgtatggcttaccagcagatatcatggagacggacaaaacgctagatgagaggcgagctgacttggtgcactccgctgcaaatttgctggataggaataatttgataaagtacgacaggaaaacaggatactttcaggttactgatcttggaaggattgccagttattactatattagtcatgggactatatcgacgtacaatgagtatctgaagcccacgatgggtgatattgagctgtgtcgattgttctctttgagtgaagagtttaagtatgttagtgtcagacaagatgagaagatggagctggcaaagcttttggatcgtgtgccaattcctataaaagagagtttagatgagcccagtgcaaagatcaatgtgctgttgcaagcatatatatctaggttgaaactggagggcctctcccttggttctgatatggtctacatcagacagagtgctggccgacttctacgagcactttttgagatagttctgaagaggggatgggctcagttagcagagaaggctctgaatctttgcaagatgattgataagcagatgtggagtgtccaaacacccttgcgccagtttcctggtattccaaaggaaattttgatgaaactggagaagaaagaattggcctgggagaggtactatgacctgtcatcgcaggaaatcggtgaactaatccggtttcaaaagatggggaagcagctgcacaggtgcatccaccagttgccgaagttgaacctttctgcccatgttcaacctattactcgcacagttttgggtttcgaactgactataacgcctgatttcctatgggatgataaggtacatggatatgttgagcccttttgggttatagttgaggacaatgatggagagtacattcttcaccatgagtacttcatgcttaagaaacaatacgtggatgaagatcacacacttcactttacagtgccgatatatgagccactgcctcctcagtattttatacgtgttgtatctgacaagtggcttggttctcagacgattctccctgtttgctttaggcacttgattcttccagaaaaatatgctccaccaactgaattgcttgatctgcagccactacctgtcactgcattaaggaatgcacgatatgaaggtctttatagtgcttttaaacatttcaaccccatccagactcaagtgttcactgtcttgtataatagtgacgacagtgtcttggttgctgcaccaactggtagtgggaagactatctgtgcggaatttgctatactaaggaaccaccagaaggctgtatctggtgaaaccaacatgcgtgttgtgtatatagcacctattgaggctctggccaaagaaagatacagagactggtcaaagaaatttggtgaatttgcccgtgtagttgagctaacaggcgaaactgcagctgatttgaaacttcttgacaaaggggagatcattattagtactcctgaaaagtgggatgcactttctcgtcggtggaagcagcggaaacctgtccagcaagtcagcttatttattgttgatgagcttcatctaattggatctgagaagggacatgtcctggaaatagttgtctctcggatgaggcgtatttcaagtcatattggcactaacatccggattgtagccctttcagcatcacttggaaatgctaaagatcttggagaatggattggcgctactgctcatggtcttttcaacttccccccagcagtgcggccagttccactggaaatacacattcagggtgtggatatagcaaattttgaggcaagaatgcaagcaatggcgaagccaacatacactgctatcactcaacatgcaaagagtggtaagcctgccctggtgtttgtgccgacacggaagcatgcaaggttgactgcattggacctgtgtgcatactcaagtgctgagggtgccggtacaccattccttcttgggtcccaagatgagatggatactttcattggaggtgtcaatgaagaaacgcttaaaaatacgctgagatgtggtgtgggctacttgcatgagggtcttagtgaccttgaccaggaacttgtgactcagctctttcttggtgggaggatccaagtgtgtgttgcaagcagcacgatgtgctgggggagatcattgcctgctcatttagttgttgtgatgggaacccagtattatgatggccgggagagtgctcatactgattatccaatcactgatctgctgcagatgatgggtcatgctagcaggcctcttcaagataactctgggaaatgcgttatattgtgccatgcacctcggaaagagtactacaagaagttcctttttgaggccttccctgtggagagtcatctccatcatttcttgcatgaccatatgaatgctgaggttgttgtgggtgttgtagaaaacaaacaagatgcagtggactatcttacatggactttcatgtacaggcggctgaacaagaaccctaactactacaatctgcagggtgtaagtcacaggcatctgtcagatcatctttctgagctaatcgagacagtgttgaatgacctggagtcaagcaagtgtgtggctgtagaggaggacatgtacctgaagccgctcaaccttggtctcattgctgcgtactactacatcagttacaccactatcgaacggttcagttcgatgctaactcagaagactaagatgaaaggtctcctggaaattctagcttcggcatcagaatatgcagagcttccaagtcgcccaggcgaagaggaatacattgagaggctagtccgtcaccagaggttttctattgacaagcccaagtatggcgatccacatgtcaaggccaacgccctgctgcaatcccactttgcaaggcacacggtggtagggaacctggcagcagaccagcgggagatcctcctttccgcccatagactgctcctggcgatggttgatgtcatctccagcagcggatggctcactctggctctgaatgcaatggagttgagccagatggtgacgcaaggtatgtgggatcgtgactctgtgttgctccaactcccacacttcaccagggacctggcccggcgatgccaggaaaacgaagggaaacctgtagagagtatctttgatctggctgagatgagcatcgatgagatgcgggatctgctgcagctgtcaaactctgagctgcaggacatcgttgagttcttcaagcggttccccaacgtcgacatgtcttatgaagtccgcgagggtgacgacataagggccggcgacaacgtgaccttgcaggtgactctggagcgtgacatgaccaacctgcccaactctgaggtcggcccggtgcacgcccccaggttccccaagaccaaggaggaaggttggtggctggtggtcggcgacagctccaccaagcagctgctggcgatcaagagggtcaccctccagaaaagggcccgtgtgaagcttgagttcaccgccgccaccgagacagggaggaaggactacatgatctacctgatgtcagactcctacctcggctgtgaccaggagtacgagttcaccgtcgacatcaaggaagctggaggtgactgatttagatcaccaaaaactcttttttataccttttttttcctgctcttatgcagagattattatgtgacctgaaacttgttatcatcttcttgtctgtaatgtaacacctgaagtttagctttgattcagtgtaacctgatgcacatgttttcgctttttttgtatcaacaaaggaggatctgcactaattgtgggattttgcttgtgtttattggcctgatgatgttttggtgatgagtatgtgtcgttcatgatactttgatgtgaattattggtttg

SEQ ID NO: 3634 - DNA, 6783 bp, Brachypodium distachyon
cggcggcggcgggcggcgatggcgaacctgggcgggggcgcggaggcgcacgcgcggttcaagcagtacgagtacagggccaactcgagcctggtgctcaccaccgactcgcgcccgcgggacacgcacgagcccacgggcgagccggagacgctctggggcaggatcgacaagaagaacttcggggaccgcgccgtgcaggccaagccccccgagctcgaggagcggctcaccaagtcgcgcaagaagaaggagcgcgacgcggcaaccgccggcgaccgcgacgccgccgacaacctcccgcggaagcgcaggcgccgcgccgccgcccagcgcgagcaggagagcgtgctctcgctcgccgacgacgtcgtctacaggccccagaccaaggagacgcgcgccgcctacgaggccatgctcagcgtcatccagcagcagtttggcggccagccgctcgacgtgctcgggggcgccgcggacgaggtgctgaccgtcctcaagaacgacaagatcaagaaccctgacaagaagaaggagatcgagaagctcctcaaccccatctccaaccagatgttcgaccagttcgtctccattgggaagctcatcaccgatttccatgatgccagcgatcctgccgctgcgccttctgctgatggattggacgcgaccatggatgatgatattggagttgctgtcgagtttgaagaggacgatgacgacgaggaaagtgattttgatcaggtgcaagatgaattggatgaggaggatgacgatgtggctgagttgaaccgtcctggaggtatgcaaatgggcggtgagttggatgacgatgatttgcagaactccaatgaggggctgaccataaacgtgcaagacattgatgcttactggctacagagaaagataacacaagcgtacgaagatattgatcctcagcaaagccagaagcttgccgaggagatcttgaagataattgctgagggtgatgacagagatgttgagaatcgccttgtcatggagttggactatgagaaattcgatctcattaagttggtactacgcaatcggttcaagatagtttggtgtacccgcttagccagggctgaagatcaggaagagcggaagaagatagaggaagagatgatggataacccaacattagctccaattttggagcagctgcatgcaactagagcatccgcaaaggagaggcaaaagaatctggagaagagtatcagggatgaggccaaaaggcttctaaacaatgacaatactgctggcactgatggtccgagggatcgcagggcagttgacagggatatggagagtggatggttgaagggccagaggcagctgcttgatcttgacagcctttccttccaccaaggcggtcttttgatggccaacaagaagtgtgaacttcctgagggatcatttagaacacctcacaaggggtatgaagaagtccatgtccctgcattgaaagctaggccatatggagctggagagaagattgtaaagatatctgacatgccagggtgggctcaacctgcttttgctggaatgcaacaattgaatagggttcagagcagggtttatgataccgccctttttaaaccagataacatccttctctgtgctccaactggtgctgggaaaaccaacgtggctgttcttacaattcttcaccagattggtttgcatatgaaggacggtgagtttgacaataccaagtacaagattgtgtatgtggccccaatgaaagctttggttgctgaagttgttggaaatttgtcggcacgactgaaggacttcaatgttactgtaagggagctcagtggagaccagaacctgacgaaacaacagattgatgagacacagatcattgtcactacacctgagaaatgggatattgttactaggaaatcaggtgacagaacctatactcaaatggtgaagcttctaatcattgatgagatccatttacttcatgacaacagagggcctgtcctcgagagcattgtttctagaactgtacggcagattgagacaaccaaggaacatatccgcctagttgggctctcagcaactctaccaaactatgaagatgttgctgtgttcttgcgtgttcgctccgagggactcttccactttgataacagttaccggccttgccctcttgctcagcagtacattgggatcaccgtgaggaagccactgcagaggtttcagttgatgaatgagatttgttatgagaaagtgatggctgctgcgggtaagcatcaagtgcttatatttgttcactccaggaaggagacagcgaaaactgcccgtgccatcagagacactgccttggctaatgacacattgactcgctttctgaaggatgagagtgcaagccaggagatccttagcagtcaggcagagcttgtcaaaagcagtgatcttaaagaccttttgccttacggatttgctattcatcatgctgggatggcaagggtagaccgtgaatttgtcgaggagctttttgctgataagcatatacaggttcttgtttcgacagctacccttgcatggggtgtcaacttgcctgcacacactgttattataaagggtacccagatttacaatccagaaaaaggtgcttggacagaattaagtcctctggatgtcatgcagatgcttggtcgtgcaggcaggcctcagtatgacacacatggagagggaataatcttaactggccacagtgaactgcaatactacctctcgcttatgaaccagcagctgcctattgagagccagttcgtatccaaattggcggatcaactaaatgcagagattgttctgggaactattcagaatgctcgggaggcatgctcgtggcttggctacacttacctctacatccggatgctcaggaatccaacactatatggtttaccagcagatatcatggagacagacaaaacactagatgaaaggagagctgacttggtacactctgctgcaaatttgttggataagaataatttgataaagtacgatcggaaaacagggtactttcaggttactgacctgggaaggattgccagttattactatattagtcatggtactatttcgacatacaatgagtatttgaagcctacgatgggtgatattgagctgtgtcgactcttctctctgagtgaagaatttaagtatgttagtgtcaggcaagatgagaaaatggagctggcgaagcttttggatcgtgtaccaattcctgtaaaagagagtttggaggagcccagtgcaaagatcaatgttctgctgcaagcatatatatctaggctgaaactggagggcctctcccttggttctgacatggtctacattagacagagtgctggccgtctcttgcgtgcactatttgagatagttttgaagagagggtgggctcagctagcagagaaggctcttaatctttgcaagatgattgataagcagatgtggagtgtccaaacacccttgcgccagtttcctggtattcccaaggaaatcttgatgaaactggagaaaaaagaattggtttgggagaggtactatgacctatcatcagctgaaattgggcaactgatccgtttcgacaagatggggaagcagttgcataggtgcatccaccagttaccaaagttgaacctttcagcgcatgtccaacctattactcgcacagttttgggttttgaactgactataacacctgatttccaatgggatgataaggtacatggatatgttgaggccttttgggttatagttgaggacaatgacggcgagtacattcttcaccatgagtatttcatgcttaagaagcaatatgtggaagaagatcacacgcttcactttacagtgccaatatatgagccactgcctcctcagtattttatccgtgttgtctctgacaagtggcttggttctcagactattcttcctgtctgttttaggcacttaattcttccagaaaagtatgctccaccaactgaattgcttgatttgcagccgttacctgttactgcattgaggaatgcacgatatgaaggcctttatagtgcttttaaacatttcaaccccatccagactcaagttttcactgtcttgtacaacagtgatgacactgtgttagttgctgcaccaacgggcagcgggaagaccatatgtgcggaatttgctatactgagaaaccatcagaaggccttatctggggaaactaacatgcgtgttgtgtatatagctcctattgaggcgcttgcaaaagaaagatacagggactggtcgaagaaatttggagaatttgcccgtgtagttgagctaactggtgaaacagcagctgatttgaagcttcttgacaaaggagagatcattattagtactcctgaaaagtgggatgcactctcgcgccggtggaaacagcgcaaacatatccagcaagtcagtttatttattgttgatgagcttcatctgattggatctgaaaagggacatgtcctggaaatcattgtctctaggatgaggcgtatttcaagtcatattggcagtaacatccggattgtggcgctttcagcatcacttggaaatgccaaagatctcggagaatggatcggtgcaactgctcatggtctttttaacttccctccagcagtgcgacccgttccattggaaatacacattcagggtgttgatatcgcaaattttgaggcaagaatgcaagcgatggcgaagccaacatacactgctgtcacacagcatgcgaagaatggcaagcctgccctggtgtttgtaccaacacgtaagcatgcaaggttgactgcattggacctgtgcgcatactcgagtgccgagggtgctggaacaccattccttcttgggtcaaaagatgagatggatactttcactggaggtgtcaatgaagaaacacttaaaaataccctgaagtgtggtgtaggctacttgcatgaaggtcttagtgaacttgaccaggaactcgtaactcagctctttcttggtgggaggatccaagtctgtgttgcgagcagcacaatgtgctgggggagatcattgcctgctcatttagttgttgtgatgggaacccaatattatgatggtcgggagagtgctcatactgattatccaatcactgatctgctacaaatgatgggtcatgctagcaggcctcttcaagataactcaggaaaatgtgttatattgtgccatgcacctcggaaggaatactacaagaagttccttttcgaggccttccctgttgagagccatcttcaccatttcttgcatgatcatatgaatgccgaggttgttgtgggtgttgtagaaaacaagcaagacgccgtcgactaccttacctggactttcatgtatcggcggctgaacaagaaccctaactactacaatctgcagggtgtaagtcacaggcatctgtcggaccatctctctgagctgatcgaaacagtgttgactgacctagaatcgagcaagtgtgtggctgtagaggaggatatgtacctgaagccactcaaccttggtctcattgccgcgtactactacattagctacacaacaatcgaacgattcagttcgatgttaactcagaagactaagatgaagggtcttctggagattctagcttctgcatcagaatatgctgagcttccaagtcgcccaggtgaagaagaatacattgagaggctagttcgtcaccagaggttttctattgagaagcccaagtatggtgatccacatgtcaaggccaacgcactgctgcagtcccactttgcaaggcacacagtggttgggaaccttgcagctgaccagcgggagatcctcctttctgcccatagattactccaggcaatggttgatgttatctccagcaatggatggctcagtcttgctctcaacgcaatggagttgagtcaaatggtgacacaagggatgtgggaccgtgattctgtgctgcttcaaattccgcactttaccagggagctagctcggagatgccaggaaaatgaagggaagcccattgagagcatctttgaactggcggagatgggcattgatgagatgcgggatctgctgcagctatcaaactctgagctgcatgacgttgtcgaattcttcaaacggttccccaacatcgacatggcttatgaagttcgcgagggcgatgatataagggccggcgacagcgtaaccttgcaggttactctggagcgtgacatgacgaacttgccgtccgaggtcgggccagttcatgccccaaggttcccgaagcccaaggaagaaggctggtggctggtggtcggcgacttctccaccaaacagttgctggcgatcaagagggtcgccctccagaagagggctcgggtgaagctcgagttcactgctgctgcagaaccagggcagaaggagtacatgatctacctgatgtcggattcctacctgggctgcgaccaggagtacgagttcaccattgacgtgaaggatgctggagcggattgattggcagggaactcttgtatcttttttatgtaaccagagaacttgacgatttccctgtttgtaatatctgaagttttagctttaattcagtgtaattgatgcgatcttgtgctggtgcttgtgctatttgtgtttttgtatgatgacgatctggcacggtattgtggatgtattaaacatcttttacagctatgttagaagccccaaggatctgaatattcgtgc

SEQ ID NO: 3635 - DNA, 6871 bp, Brachypodium distachyon
gcggctgccgacccgccgaaccaaagcggcggcggcgggcggcgatggcgaacctgggcgggggcgcggaggcgcacgcgcggttcaagcagtacgagtacagggccaactcgagcctggtgctcaccaccgactcgcgcccgcgggacacgcacgagcccacgggcgagccggagacgctctggggcaggatcgacaagaagaacttcggggaccgcgccgtgcaggccaagccccccgagctcgaggagcggctcaccaagtcgcgcaagaagaaggagcgcgacgcggcaaccgccggcgaccgcgacgccgccgacaacctcccgcggaagcgcaggcgccgcgccgccgcccagcgcgagcaggagagcgtgctctcgctcgccgacgacgtcgtctacaggccccagaccaaggagacgcgcgccgcctacgaggccatgctcagcgtcatccagcagcagtttggcggccagccgctcgacgtgctcgggggcgccgcggacgaggtgctgaccgtcctcaagaacgacaagatcaagaaccctgacaagaagaaggagatcgagaagctcctcaaccccatctccaaccagatgttcgaccagttcgtctccattgggaagctcatcaccgatttccatgatgccagcgatcctgccgctgcgccttctgctgatggattggacgcgaccatggatgatgatattggagttgctgtcgagtttgaagaggacgatgacgacgaggaaagtgattttgatcaggtgcaagatgaattggatgaggaggatgacgatgtggctgagttgaaccgtcctggaggtatgcaaatgggcggtgagttggatgacgatgatttgcagaactccaatgaggggctgaccataaacgtgcaagacattgatgcttactggctacagagaaagataacacaagcgtacgaagatattgatcctcagcaaagccagaagcttgccgaggagatcttgaagataattgctgagggtgatgacagagatgttgagaatcgccttgtcatggagttggactatgagaaattcgatctcattaagttggtactacgcaatcggttcaagatagtttggtgtacccgcttagccagggctgaagatcaggaagagcggaagaagatagaggaagagatgatggataacccaacattagctccaattttggagcagctgcatgcaactagagcatccgcaaaggagaggcaaaagaatctggagaagagtatcagggatgaggccaaaaggcttctaaacaatgacaatactgctggcactgatggtccgagggatcgcagggcagttgacagggatatggagagtggatggttgaagggccagaggcagctgcttgatcttgacagcctttccttccaccaaggcggtcttttgatggccaacaagaagtgtgaacttcctgagggatcatttagaacacctcacaaggggtatgaagaagtccatgtccctgcattgaaagctaggccatatggagctggagagaagattgtaaagatatctgacatgccagggtgggctcaacctgcttttgctggaatgcaacaattgaatagggttcagagcagggtttatgataccgccctttttaaaccagataacatccttctctgtgctccaactggtgctgggaaaaccaacgtggctgttcttacaattcttcaccagattggtttgcatatgaaggacggtgagtttgacaataccaagtacaagattgtgtatgtggccccaatgaaagctttggttgctgaagttgttggaaatttgtcggcacgactgaaggacttcaatgttactgtaagggagctcagtggagaccagaacctgacgaaacaacagattgatgagacacagatcattgtcactacacctgagaaatgggatattgttactaggaaatcaggtgacagaacctatactcaaatggtgaagcttctaatcattgatgagatccatttacttcatgacaacagagggcctgtcctcgagagcattgtttctagaactgtacggcagattgagacaaccaaggaacatatccgcctagttgggctctcagcaactctaccaaactatgaagatgttgctgtgttcttgcgtgttcgctccgagggactcttccactttgataacagttaccggccttgccctcttgctcagcagtacattgggatcaccgtgaggaagccactgcagaggtttcagttgatgaatgagatttgttatgagaaagtgatggctgctgcgggtaagcatcaagtgcttatatttgttcactccaggaaggagacagcgaaaactgcccgtgccatcagagacactgccttggctaatgacacattgactcgctttctgaaggatgagagtgcaagccaggagatccttagcagtcaggcagagcttgtcaaaagcagtgatcttaaagaccttttgccttacggatttgctattcatcatgctgggatggcaagggtagaccgtgaatttgtcgaggagctttttgctgataagcatatacaggttcttgtttcgacagctacccttgcatggggtgtcaacttgcctgcacacactgttattataaagggtacccagatttacaatccagaaaaaggtgcttggacagaattaagtcctctggatgtcatgcagatgcttggtcgtgcaggcaggcctcagtatgacacacatggagagggaataatcttaactggccacagtgaactgcaatactacctctcgcttatgaaccagcagctgcctattgagagccagttcgtatccaaattggcggatcaactaaatgcagagattgttctgggaactattcagaatgctcgggaggcatgctcgtggcttggctacacttacctctacatccggatgctcaggaatccaacactatatggtttaccagcagatatcatggagacagacaaaacactagatgaaaggagagctgacttggtacactctgctgcaaatttgttggataagaataatttgataaagtacgatcggaaaacagggtactttcaggttactgacctgggaaggattgccagttattactatattagtcatggtactatttcgacatacaatgagtatttgaagcctacgatgggtgatattgagctgtgtcgactcttctctctgagtgaagaatttaagtatgttagtgtcaggcaagatgagaaaatggagctggcgaagcttttggatcgtgtaccaattcctgtaaaagagagtttggaggagcccagtgcaaagatcaatgttctgctgcaagcatatatatctaggctgaaactggagggcctctcccttggttctgacatggtctacattagacagagtgctggccgtctcttgcgtgcactatttgagatagttttgaagagagggtgggctcagctagcagagaaggctcttaatctttgcaagatgattgataagcagatgtggagtgtccaaacacccttgcgccagtttcctggtattcccaaggaaatcttgatgaaactggagaaaaaagaattggtttgggagaggtactatgacctatcatcagctgaaattgggcaactgatccgtttcgacaagatggggaagcagttgcataggtgcatccaccagttaccaaagttgaacctttcagcgcatgtccaacctattactcgcacagttttgggttttgaactgactataacacctgatttccaatgggatgataaggtacatggatatgttgaggccttttgggttatagttgaggacaatgacggcgagtacattcttcaccatgagtatttcatgcttaagaagcaatatgtggaagaagatcacacgcttcactttacagtgccaatatatgagccactgcctcctcagtattttatccgtgttgtctctgacaagtggcttggttctcagactattcttcctgtctgttttaggcacttaattcttccagaaaagtatgctccaccaactgaattgcttgatttgcagccgttacctgttactgcattgaggaatgcacgatatgaaggcctttatagtgcttttaaacatttcaaccccatccagactcaagttttcactgtcttgtacaacagtgatgacactgtgttagttgctgcaccaacgggcagcgggaagaccatatgtgcggaatttgctatactgagaaaccatcagaaggccttatctggggaaactaacatgcgtgttgtgtatatagctcctattgaggcgcttgcaaaagaaagatacagggactggtcgaagaaatttggagaatttgcccgtgtagttgagctaactggtgaaacagcagctgatttgaagcttcttgacaaaggagagatcattattagtactcctgaaaagtgggatgcactctcgcgccggtggaaacagcgcaaacatatccagcaagtcagtttatttattgttgatgagcttcatctgattggatctgaaaagggacatgtcctggaaatcattgtctctaggatgaggcgtatttcaagtcatattggcagtaacatccggattgtggcgctttcagcatcacttggaaatgccaaagatctcggagaatggatcggtgcaactgctcatggtctttttaacttccctccagcagtgcgacccgttccattggaaatacacattcagggtgttgatatcgcaaattttgaggcaagaatgcaagcgatggcgaagccaacatacactgctgtcacacagcatgcgaagaatggcaagcctgccctggtgtttgtaccaacacgtaagcatgcaaggttgactgcattggacctgtgcgcatactcgagtgccgagggtgctggaacaccattccttcttgggtcaaaagatgagatggatactttcactggaggtgtcaatgaagaaacacttaaaaataccctgaagtgtggtgtaggctacttgcatgaaggtcttagtgaacttgaccaggaactcgtaactcagctctttcttggtgggaggatccaagtctgtgttgcgagcagcacaatgtgctgggggagatcattgcctgctcatttagttgttgtgatgggaacccaatattatgatggtcgggagagtgctcatactgattatccaatcactgatctgctacaaatgatgggtcatgctagcaggcctcttcaagataactcaggaaaatgtgttatattgtgccatgcacctcggaaggaatactacaagaagttccttttcgaggccttccctgttgagagccatcttcaccatttcttgcatgatcatatgaatgccgaggttgttgtgggtgttgtagaaaacaagcaagacgccgtcgactaccttacctggactttcatgtatcggcggctgaacaagaaccctaactactacaatctgcagggtgtaagtcacaggcatctgtcggaccatctctctgagctgatcgaaacagtgttgactgacctagaatcgagcaagtgtgtggctgtagaggaggatatgtacctgaagccactcaaccttggtctcattgccgcgtactactacattagctacacaacaatcgaacgattcagttcgatgttaactcagaagactaagatgaagggtcttctggagattctagcttctgcatcagaatatgctgagcttccaagtcgcccaggtgaagaagaatacattgagaggctagttcgtcaccagaggttttctattgagaagcccaagtatggtgatccacatgtcaaggccaacgcactgctgcagtcccactttgcaaggcacacagtggttgggaaccttgcagctgaccagcgggagatcctcctttctgcccatagattactccaggcaatggttgatgttatctccagcaatggatggctcagtcttgctctcaacgcaatggagttgagtcaaatggtgacacaagggatgtgggaccgtgattctgtgctgcttcaaattccgcactttaccagggagctagctcggagatgccaggaaaatgaagggaagcccattgagagcatctttgaactggcggagatgggcattgatgagatgcgggatctgctgcagctatcaaactctgagctgcatgacgttgtcgaattcttcaaacggttccccaacatcgacatggcttatgaagttcgcgagggcgatgatataagggccggcgacagcgtaaccttgcaggttactctggagcgtgacatgacgaacttgccgtccgaggtcgggccagttcatgccccaaggttcccgaagcccaaggaagaaggctggtggctggtggtcggcgacttctccaccaaacagttgctggcgatcaagagggtcgccctccagaagagggctcgggtgaagctcgagttcactgctgctgcagaaccagggcagaaggagtacatgatctacctgatgtcggattcctacctgggctgcgaccaggagtacgagttcaccattgacgtgaaggatgctggagcggattgattggcagggaactcttgtatcttttttatgtaaccagagaacttgacgatttccctgtttgtaatatctgaagttttagctttaattcagtgtaattgatgcgatcttgtgctggtgcttgtgctatttgtgtttttgtatgatgacgatctggcacggtattgtggatgtattaaacatcttttacagctatgttagaagccccaaggatctgaatattcgtgctgatggtttgatggctgcatttctgaatctgaatgttcatgccgatgatttcattgtttcgg

SEQ ID NO: 3636 - DNA, 6661 bp, Triticum aestivum
ccgcgggacacgcacgagcccacgggcgagcccgagacgctctggggccggatcgacaagaggagcttcggcgaccgcgccgtgcaggccaagccccccgagctcgaggaccgcctcaccaagtcccgcaagaagaaggagcgcgacgccgccgcctctgccggcgacgccgacgccgaccagccccgcaagcgcaggcgccgctcctccgccgcccagcgcgaggagagcgtgctctcccttgcggacgatgtcgtctacaagccccagaccaaggagacgcgcgccgcctacgaggccatgctcagcgtcatccagcagcagttcggcggccagccgctcgacgtgcttggcggcgctgctgatgaggtgctcgccgtcctcaagaatgacaagatcaagaaccctgacaagaagaaggagatcgagaagctcctcaaccccatctccagcgccatgttcgaccagtttgtctccatcgggaagctcatcacagatttccatgatgccagcgaccctgctgctgctccttctggtgatggcggggacgccaccatggatgatgatattggagttgctgtcgagttcgaggaggatgaagatgacgaggaaagtgattttgatcaggtgcaagatgacttggatgacgacgatgatgatgtggctgagttgaaccgtcctggaggtatgcagatgggcggagagttggatgacgatgatatgcagaactccaatgaggggctgaacataaacgtgcaggacattgatgcttactggctgcagaggaagataacacaagcatacgaagatattgatccccagcagagccagaagcttgccgaggagatattgaagataattgctgtgggtgacgacagagatgttgagaatcgccttgtcatggagttggactatgagaaattcgatctcattaagttggtactgcgcaaccggttcaagatagtctggtgtacccgcttagccagggctgaagatcaggaagagcggaagaagatagaggaagagatgatggataacccaagcttagccccaatattggagcagctacatgcaacgagagcctctgcaaaggagaggcagaagaatctggagaaaagtatcagggatgaggccaagaggcttcttaacaatgacagtgctggcgctgatggtccaagggagcgtcgggcagttgagcgggatacggagagtggatggctaaagggccagaggcagctgcttgatcttgatagcctctccttccaccaaggtggtctcttgatggccaacaagaaatgtgaacttcccgagggatcatttagaacccctcataaggggtatgaagaagtccatgtgccagcattgaaacctaggccatatggaactggagagaagattgtgaagatatctgatatcccagggtgggcacaaccggcttttgctggaatgcagcagctgaacagggtccagagcaaggtttatgatactgcccttttcaaaccagacaacatccttctctgtgctccaactggtgctggtaaaaccaatgtggctgtgcttacaattcttcaccagattggtttgcatatgaaggatggtgagtttgataatagcaagtacaaaattgtctatgtggccccaatgaaagctctggttgctgaagttgttggaaacttgtcggcacggcttaaagacttcaatgttaatgttagggagctcagtggagaccagaatctgacaaaacaacagattgatgatacacagatcatcgtcaccacacctgagaagtgggatattgtcacgaggaaatctggggacagaacatacactcaaatggtaaagcttctgatcatagatgagatccatctgcttcatgacaacagagggcctgtcctggagagtattgtttctagaacagtacggcagattgagacgaccaaggaacatattcgcctagttggcctctctgcaactcttccaaactatgaagatgttgctgtattcctgcgtgttcgctctgagggtctcttccattttgataacagttaccggccttgccctcttgctcagcagtacattgggatcactgtgaggaagccactgcagaggtttcagttgatgaatgagatctgttatgagaaagtaatggcttctgctggtaagcatcaagtgcttatttttgtgcactccaggaaggagacatcgaaaactgctagggccatcagagacactgccttggcgaatgatacattgactcgctttctgaaggatgagagtgcaagccaggagatccttggcagtcatacagatattgtcaaaagcagtgatcttaaagaccttttgccgtatgggtttgctattcatcatgctgggatggcaagggtagaccgtgaacttgttgaggaactttttgctgataagcatatacaggtccttgtttcgacagccacccttgcttggggtgtcaacttgcctgcacatactgttattataaagggcacacagatttataatccggaaaaaggtgcttggacagaattaagtcctctggatgtcatgcagatgcttggtcgtgcaggtaggcctcagtatgacacacacggagagggaataatcttaactggccacagtgaattgcaatactatctctcccttatgaatcaacagctgcctatcgagagtcagttcgtatccaagttggcagatcagttaaatgcagagattgttctgggtactattcagaatgctcgggaagcatgctcttggcttggctacacttatctctacatccggatgctgcggaatccaacgctgtatggcttaccagcagatatcatggagacggacaaaacgctagatgagaggagagctgacttggtgcactctgctgcaaatttgctggataggaataatttgataaagtacgacaggaaaacaggatactttcaggttactgaccttggaaggattgccagttattactacattagtcatgggactatttcgacatacaatgaatatctgaagcccacgatgggtgatattgagctgtgtcgattgttctctctgagtgaagagtttaagtatgttagtgtcagacaagatgagaagatggagctggcaaagcttttggatcgtgtgccaattcctgtaaaagagagtttggaggagcccagtgcaaagatcaatgtgctgttgcaagcatatatatctaggttgaaactggagggcctctcccttggttctgatatggtctacatcagacagagtgctggccgacttctacgagcgctttttgagatagttctgaagaggggatgggctcagttagcagagaaggctctgaatctttgcaagatgattgataagcagatgtggagtgtccaaacacccttgcgccagtttcctggtattccaaaggaaattctgatgaaactggagaaaaaagaattggcctgggagaggtactatgacctatcatcgcaggaaatcggtgaactaatccggtttcaaaagatggggaagcagctgcacaggtgcatccaccagttgccgaagttgaacctttctgcccatgttcaacccattactcgcacggttttgggtttcgaactgactataacacctgatttcctatgggatgataaggtacatggatatgttgagcctttttgggttatagtcgaggacaatgatggagagtacattcttcaccatgagtacttcatgcttaagaaacaatacgtggatgaagatcacacacttcactttacagtgccgatatatgagccactgcctcctcagtattttatacgtgttgtatctgacaagtggcttggttctcagacgattctccctgtttgctttaggcacttgattcttccagaaaaatatgctccaccaactgaattgcttgatctgcagccactacctgtcactgcattgaggaatgcacgatatgaaggtctttatagtgctttcaaacatttcaaccccatccagactcaagtgttcactgtcttgtataatagtgacgacagtgtattggttgctgcaccaactggtagtgggaagactatatgtgcggaatttgctatactaaggaaccaccagaaggctgtatctggggaaaccaacatgcgtgttgtgtatatagcacctattgaagctttggccaaagaaagatacagagactggtcaaagaaatttggtgaatttgcccgtgtagttgagctaacaggcgaaactgctgctgatttgaaactgcttgacaaaggggagatcattattagtactcctgaaaagtgggatgcactttctcgccggtggaagcagcggaaacctgtccagcaagtcagcttatttattgttgatgagcttcatctaattggatctgagaagggacatgtcctggaaatagttgtttcccggatgaggcgtatttcaagtcatattggcagtaacatccggattgtggcactttcagcgtcacttggaaatgctaaagatcttggagaatggattggcgctactgctcatggtcttttcaacttccccccagcagtgcggccagtcccattggaaatacacatccagggtgtggatatagcaaattttgaggcaagaatgcaagcaatggcaaagccaacatacactgccatcacacaacatgcaaagagtggtaagcctgccctggtgtttgtgccgacacggaagcatgcaaggttgactgcattggatttgtgtgcatactcaagtgctgagggtggtggtacaccgttccttcttgggtcccaggatgagatggatactttcattggaggtgtcaatgaagaaacgcttaaaaatacgctgagatgtggtgtgggctacttgcatgagggccttagtgaccttgatcaggaacttgtgactcagctctttcttggtgggaggatccaagtgtgtgttgcaagcagcacgatgtgctgggggagatcattgcctgctcatttggttgttgtgatgggaacccagtattatgatggtcgggagagtgctcatactgattatccaataactgatctgctacagatgatgggtcatgctagcagacctcttcaagataactcagggaagtgtgttatattgtgccatgcacctcggaaggaatactacaagaagttcctatttgaggccttccctgtggagagtcatctccaccatttcttgcatgatcatatgaatgctgaggttgttgtgggtgttgtagaaaacaaacaagatgcagtggactatcttacatggacattcatgtacaggcggctgaacaagaaccccaactactacaatctgcagggtgtaagtcacaggcatctgtcggatcatctttctgagctaatcgagacagtgttgaatgacctggagtcaagcaagtgcgtggctgtagaggaggatatgtacctgaagccgctcaaccttggtctcattgctgcttactactacatcagctacaccactatcgaacggttcagttcgatgctaactcagaagaccaagatgaaaggcctcctggaaattctagcttcggcatcggaatatgcagagcttccaagtcgcccaggcgaagaggaatacattgagaggctagtccgtcaccagaggttttctattgacaaacccaagtatggtgatccacatgtcaaggcgaacgccctgctgcaatcccactttgcaaggcacacggtggtagggaacctggcagccgaccagcgggagatcctcctttctgcccataggctgctcctggcaatggttgatgtcatctctagcagtggatggctcactctggctctgaatgcaatggagctgagccagatggtgactcaaggcatgtgggatcgtgattctgtgctgctccaacttccacacttcaccagggacctggcccggagatgccaggaaaatgaagcgaagcccatcgagagcatctttgatctggctgagatgagcattgatgagatgcgggacctgctgcagctgtcaaactctgagctgcaggacgtggtccagttcttcaagcggttccccaacgtcgacatgacatatgaagtccgtgagggcgacgacataagggccggtgacaacgtgaccttgcaggtgactctggagcgtgacatgaccaacctgccgaactctgaggtcgggccggtgcacgcccccaggttccccaagaccaaggaggaaggctggtggctggtggtcggcgacagctccaccaagcagctgctggcgatcaagagggtcactctccagaaaagggcccgtgtgaagcttgagttcaccgccgccgtggagccagggagcaaggactacatgatctacctgatgtcggactcctacctcggctgcgaccaggagtacgagttcaccgtcgatatcaaggaagctggaggcgactgatttcgaacacctataactcttttttatactgggtttttgctcttatgtgagtgtgacatgaaacttattatcatcctcttgtctgtaatgtaacacctgaagtttagctttgattcagtgtaacctgatgcacacgtacgttattgtgtttttgtatggcaacgaggaggatctgcactggttgctgatgatgttttgctgatgttcttatgtgatgttt

SEQ ID NO: 3637 - DNA, 6562 bp, Sorghum bicolor
atggccaacctaggcggtggcggcggcgcagaggcgcacgcgcgcttcaagcagtacgagtaccgcgccaacgccagcctcgtcctcaccaccgactcccgcccccgcgacacccaccacgagcccagcggcgagccccagacgcagtggaacaggatcgaccccaagtccttcggcgaccgcgccgtccagaacaagccgccgcccgagctcgaggagaagctctccaggtcgcgcaccaggaaagccaagcgcgacgcggccaacaccggcctcccccgccgcgacgccaagcgcaggcgacgcgccgcctccgaccgggggatcagcgtcctatccctcaccgacgacgccgtctacatgcctcagaccaaggagacgagcgccgtctacgatgccctgctcagcctcatccagcagaaactcggcggccagccgctcgacgtgctcgcgggggccgcggaggaggtgctcgccaccctcaagaatgacaaggttaagaaccctgacaagaagaaggccatcgagcagctcctcggcaccacctccaaccggctctttgaccagcttgtctccataggtaagcttatcacggactttcatgatgtggcggccagcaatgctggtgccggtgcgccttttgctgatgcaatggacaccaccctggatgataatgtcagttttgctgtcgggtgggaagaaaatgaagacgatgagagtggttctgatcaggtgcaggatgagttggatgacgacaatgaagacgacaccactgagttgaacggtcttgaaggtatgcaaatggacagtgcactagatgataatgacatgcagaacgccaaccaggggctggctgttaatgttcaggacatcgatgcttattggcttcagaggaagatattccaagcatatggggatggggacattgatgtgcagcagagccagaagcttgcggagaatatcttgaagattatagctaagggcgatgacagagatgtcgagaatcaccttgtcatgctcttggactatgagaagtttgatctcattaagttgctgctgcgcaaccggctcaaggttgtttggtgcacacgcttagccagggccgaagatcaggaacagaggaagaatatagaggaagagatgataaatgacccaagcttggctccaatattggagcagctacatgcaaccagagcatctgcgaaggagaggcaggagaatgtggagaaaagcatcagggatgaggccaagaggctcctcaacaatgatggtgtgagcaatcgcagggcagccgagggggatatggagagtgaatggttcaaaggacagaagcggctgcttgatcttgacagcctctcttttcaccagggtggtctcttcatgtccatcaagaaatgtgaacttcccaccggatcatttagaatctctcacaagggatatgaggaggttcatgtgccagcaccgaaggctaaaccctatgaaacaggggagaagattgtgaagatatctgatatgccagagtgggcaaaaccagctttcgatgggatgacacagctgaacagaattcagagcagggtctatgatactgctcttttcaaaccagacaatattcttatctgcgccccgactggtgctggcaaaacaaatgtcgctgtacttacgatccttcagcagatcggtctgcatatgaaggacggagagtttgaaaataccaagtacaaaattgtctatgtggccccaatgaaagcattggttgctgaacttgttggaaacttgtcgaagcgtttggcatattacaacgttactgttaaggagctcagtggagaccaaaacttgaccaagcaacagattgacgaaacacaggttattgtcacgacacctgaaaaatgggatattgtgactaggaaatcaggggacagaacctatacccaactggtgaagctgttaatcattgatgagatccatctgctgcatgataacagaggacctgttttggaaagcattgttgctaggacagtcaggcaaattgagacgaccaaggtgcatattcgtctcgttgggctatctgcgactctaccaaaccatgacgatgttgcactattcttgcgtgttcacaaagtaaaccttttctattttgataactgttaccgaccctgccctcttgctcagcagtacattgggataactgtgaggaagccactacagaggatatggttgatgaatgagatttgttatgagaaggttatggcttctgctggtaagcatcaagtgcttatatttgtacactcgaggaaggacactgcaaaaactgccaaagccatcagagatctagctttagcaaacaatacagtcagctgctttttgaagaatgagagtgcaagccaagagatacttggcactcatgcagatcttgtcgataacaatgatcttaaagacctcctgccgtatgggtttgctattcatcattcagggatggcaagggtcgaccgtgaacttgttgaggaactttttgctgacaagcacattcaagtacttgtgtccactactacccttgcatggggtgtcaatttgcctgcacatactgttatcataaagggcacacagatttacagcccggaaaaaggtgcttggacagaactatgccctctggatgttctacagatgcttggtcgtgcaggaaggcctcagtatgatacaaatggagagggaataatcttgactagccacagtgaattgctgttctacctgtctcttatgaatcagcagctacctattgagagtcagttcatatccaaattggctgatcaattgaatgctgagattgttctggggactattcagaatgctcgggaagcatgctcgtggcttggctatacttacctctatattcggatgcttcgcgatccgacattatatggtttgccagcagatatcttggagagggataaaacacttgaggaaaggagagccgatttgatacattctgctgcaaatctactggataagaacaatttgataaagtatgacaggaaaactggatacttccaagttactgacctgggaaggattgccagttatcactatatcagccatagaactatttcaaaatacaacgagtgcttgaagcctacaatgggggatattgagctgtgccgactgttttctctgagtgaagagtttgagcatgttggtgccaggctagatgagaaaatggaactgggaaagcttttggatcgtgtgccgattcctgtaaaagagagcttggaggatcctagtgcaaagatcaatgttctgctgcaagcatatatttctaggttgaaaccggaaggcctttctcttagctctgatatggtatacattatacagagtgctggccatctcttacgagcattgtttgagattgttctgaagaggggatgggctcaactagcggagaaggcgctgaatctttgcaaggctgttgataaacaaatgtggagtgtccaaactcccctgtggcagtttcctggaattccaacggaggtcctgatgaaactggagaaaaaggagttggcctgggagaggtgctatgatctgtcatcgcaggaacttggtgagctgatctgctatcccaagatggggcgactgctgcacaagtgcatccaccagttaccaaaattgaacctgtcagcccatgtccaaccgattactcctacggttttgagttttgagctgaccgttacacctgatttccagtgggatgataaggtgcatggatatgtcgagcccttttgggttattgttgaggacaacaatggtgagtccattcttcaccatgaatatttcttgcttaagaaacaatatgtcgatgaagatcatacgttgaacttcacagtgccgatatatgagccactaccccctaagtattttgtacatattgtgtctgacaagtggcttggttctaagacaattctccctgcctgctttagtcacttaattctaccagaaaaatatgctccaccaactcaattgctcgatctgcagcctctacctgttaatgcattgagaaatgcacaatatgagggcctctatagtgctttcaagcatttcaatcccatccagactcaagtattcactgtgttgtataacagcgatgacagcgtgttggttgctgcaccaacgggctgtgggaagacaacatgtgcagagtttgctatactaaggaaccaccagagggcagtgtctggtgagagcaacatgcgggtcgtctatatagctcccattgaagctcttgcaaaagaaagatacagggactgggggcacaaatttgcagaatttgccaaggtagttgagctcactggtgaaactacagctgatttgaagcttctggataaaggggagatcataatcagtactcctgaaaagtgggatgcactgtctcgtcggtggaaacagcaaaagcacatccaacaggtcagcttattcatagttgatgaacttcatctacttggttctgataagggacatgttttggaagtcattgtatctaggatgaggcgtatttcaagtcatattgctagtaacatacggatcgtagcactttcagcgtcacttggtaatgctaaagatctcggtgaatggattggtgccacctctcatggcctcttcaacttccctccagcattgagacctatgccattggaagttcacattcagagtgtggatatagcaaactttgaggcaaggatgcaagcaatgacaaagcctgcctacactgccatcaaacagcatacaaagaatggtaaacctgccctggtgtatgtaccaacaagtaagcatgcaaggttgactgcattggacttatgtgcatactctagtgttgagggtggtggtgcaccatttctccttgggtcagaagatgagatggatgctttcaccagaggtgttgaagaagagatgcttaagaatacacttaaatgtggtgtaggctacttgcaccagggtctaagtgaacttgatcaggaacttgtaacaaatctgctccttggtgggaggatccaagtttgtgttgtgagcagcacaatgtgttggagaagactattgccggttcatttggtggttatcatggggacccgatattgtgatggctgtgagaacgctcgcaaagattatccaattgcagatctgcttcaaatgatgggtcatgccacacttcaagataactcagggaaatgtgtcatattgtgtcatgcacctcgcaaagagtattacaaaaggttcctttctgaggccttccttgttgagagcaatcttcaccatttcttgcatgatcatatgagtgctgaggtcgtggctggtgttgtagagaataagcaagacgctgtggattaccttacttggactttcatgtatcgtcggctgacaaagaatcctaactactataatcttcagggtgtaagtcacaggcatctttcagatcatctttctgagttagttgagactgtcctgaatgatctggaatccagtaaaagtgtggctatagaggacaagtacctgaagcccctcaaccttggcctcattgcttcatactactatattagctacacaactattaaacatttcggttctatgctgacccagaagactaagatgaaaggactcctagagattctagcatctgcgtcggaatatgcagagcttgcaggtcatgctggtgaggaagaattcattgagaagcttgttcaccaccagaggttctctattgagaagcccaagtacggcgatccacatgtgaaggccaacgtgctgctgcaagcccatttttcaaggcacacagtggttgggaacctggcagctgatcagcggaagattctcatttctacccataggttgctccaggcaatggttgatgttatctccagcaatggttggcttagtcttgctcttagtgcaatggagttgagtcaaatggtgacacagggcatgtgggatcgtgattctgtgctgcttcaagttcctcacttcacaaaggacttggctcagaggtgccaggaaaatgaagtgaagcccatcgagagtatctttgatcttgctgagatgggtatcgatgagatgcgggatctcttgcagctatcaaactctcagctgaaggacatcattgagttcttcaagcggttccccaatgttgatatggtctatgaggtccgtgagggtgatgacacaagtgctggcgacaatgtagccgtgcaggtaacgctggagcgtgacatggcagacctgccatgtgaggttgggccagttcacgcgccgaggttccccaagcccaaggaagaaggctggtggctagtgattggtgacagctccactaaccagttgctggcaatcaaaagagtggcacttcagaagagggcaagaatgaaacttgagttctctgctcctgcagaagcagggacaatggactacacgatttacttgatgtcagactcttacttaggttgtgaccaggagcacaagttcactgttgatattaaggatgctggaggggatttatgatgaagaccaggatgtgctccatgactctggg

SEQ ID NO: 3638 - DNA, 6359 bp, Triticum aestivum
gcagatgcgggggccatgctcagcgtcatccagcagcagttcggcggccagccgctcgacgtcctcggcggcgctgccgacgaggtgctcgccgtcctcaagaatgacaagatcaagaaccctgacaagaagaaggagatcgagaagctcctcaaccccatctccagcgccatgttcgaccagttcgtctccattgggaagctcatcacagatttccatgacgccagcgaccctgctgctgcgccttctggtgatggtggggacgcgaccatggatgatgatatcggagttgctgtcgagttcgaggaggatgaagatgacgaggaaagtgattttgatcaggtgcaagatgacttggatgacgatgatgacgatgtggctgagttgaaccgtcctggaggtatgcagatgggcggtgagttggacgacgatgatatgcagaactccaacgaggggctgaacataaacgtgcaggacattgatgcttactggctgcagaggaagataacacaagcatacgaagatattgatccccagcagagccagaagcttgccgaggagatattgaagataattgctgtgggtgatgacagagatgtcgagaatcgccttgtcatggagttggactatgagaaattcgatctcattaagttggtactgcgcaaccggttcaagatagtctggtgtacccgcttggccagggctgaagatcaggaagagcggaagaagatagaggaagagatgatggataacccaagcttagctccaatattggagcagctacatgcaacgagagcctctgcaaaggagaggcagaagaatctggagaaaagtatcagggatgaggctaagaggcttcttaacaatgacagtgctggcgctgatggtccaagggagcgtcgggcagttgagcgggatacggagagtggatggctaaagggccagaggcagctgcttgatctcgatagcctctccttccaccaaggtggtctcttgatggccaacaagaaatgtgaacttcccgagggatcattcagaacccctcataaggggtatgaggaagtccatgtgccagcgttgaaacctaggccatatggaactggagagaagattgtgaagatatctgatatcccagggtgggcacaaccggcttttgctggaatgcagcagctgaacagggtccagagcaaggtttatgatactgcccttttcaaaccagacaacatccttctctgtgctccaactggtgctggtaaaaccaatgtggctgtgcttacaattcttcaccagattggtttgcatatgaaggatggtgagtttgataatagcaagtacaaaattgtctatgtggccccaatgaaagctctggttgctgaagttgttggaaacttgtcggcacggcttaaagacttcaatgttaatgttagggagctcagtggagaccagaacctgacaaaacaacagattgatgatacacagatcatcgtcaccacacctgagaagtgggatattgtcacgaggaaatctggggacagaacatacactcaaatggtaaagcttctgatcatagatgagatccatctgcttcatgacaacagagggcctgtcctggagagtattgtttctagaacagtacggcagattgagacgaccaaggaacatattcgcctagttggcctctctgcaactcttccaaactatgaagatgttgctgtattcctgcgtgttcgctctgagggtctcttccattttgataacagttaccggccttgccctcttgctcagcagtacattgggatcactgtgaggaagccactgcagaggtttcagttgatgaatgagatctgttatgagaaagtaatggcttctgctggtaagcatcaggtgcttatttttgtgcactccaggaaggagacatcgaaaactgctcgggccatcagagacactgccttggcgaatgatacattgactcgctttctgaaggatgagagtgcaagccaggagatccttggcagtcatacagatattgtcaaaagcagtgatcttaaagaccttttgccgtatgggtttgctattcatcatgctgggatggcaagggtagaccgtgaacttgttgaggaactttttgctgataagcatatacaggtccttgtttcgacagccacccttgcttggggtgtcaacttgcctgcacatactgttattataaagggcacacagatttataatccggaaaaaggtgcttggacagaattaagtcctctggatgtcatgcagatgcttggtcgtgcaggtaggcctcagtatgacacacacggagagggaataatcttaactggccacagtgaattgcaatactacctctcccttatgaatcaacagctgcctatcgagagtcagttcgtatccaagttggcagatcagttaaatgcagagattgttctgggtactattcagaatgctcgggaagcatgctcttggcttggctacacttatctctacatccggatgctgcggaatccaacgctgtatggcttaccagcagatatcatggagacggacaaaacgctagatgagaggagagctgacttggtgcactctgctgcaaatttgctggataggaataatttgataaagtacgacaggaaaacaggatactttcaggttacggaccttggaaggattgccagttattactacattagtcatgggactatttcgacatacaatgaatatctgaagcccacgatgggtgatattgagctgtgtcgattgttctctctgagtgaagagtttaagtatgttagtgtcagacaagatgagaagatggagctggcaaagcttttggatcgtgtgccaattcctgtaaaagagagtttggaggagcccagtgcaaagatcaatgtgctgttgcaagcatatatatctaggttgaaactggagggcctctcccttggttctgatatggtctacatcagacagagtgctggccgacttctacgagcgctttttgagatagttctgaagaggggatgggctcagttagcagagaaggctctgaatctttgcaagatgattgataagcagatgtggagtgtccaaacacccttgcgccagtttcctggtattccaaaggaaattctgatgaaactggagaaaaaagaattggcctgggagaggtactatgacctatcatcgcaggaaatcggtgaactaatccggtttcaaaagatggggaagcagctgcacaggtgcatccaccagttgccgaagttgaacctttctgcccatgttcaacccattactcgcacggttttgggtttcgaactgactataacacctgatttcctatgggatgataaggtacatggatatgttgagcctttttgggttatagtcgaggacaatgatggagagtacattcttcaccatgagtacttcatgcttaagaaacaatacgtggatgaagatcacacacttcactttacagtgccgatatatgagccactgcctcctcagtattttatacgtgttgtatctgacaagtggcttggttctcagacgattctccctgtttgctttaggcacttgattcttccagaaaaatatgctccaccaactgaattgcttgatctgcagccactacctgtcactgcattgaggaatgcacgatatgaaggtctttatagtgcttttaaacatttcaaccccatccagactcaagtgttcactgtcttgtataatagtgatgacagtgtattggttgctgcaccaactggtagtgggaagactatatgtgcggaatttgctatactaaggaaccaccagaaggctgtatctggggaaaccaacatgcgtgttgtgtatatagcacctattgaagctctggccaaagaaagatacagagactggtcaaagaaatttggtgaatttgcccgtgtagttgagctaacaggcgaaactgctgctgacttgaaacttcttgacaaaggggagatcattattagtactcctgaaaagtgggatgcactttctcgccggtggaagcaacggaaacctgtccagcaagtcagcttatttattgttgatgagcttcatctaattggatctgagaagggacatgtcctggaaatagttgtttcccggatgaggcgtatttcaagtcatattggcagtaacatccggattgtggcgctttcagcgtcccttggaaatgctaaagatcttggagaatggattggcgctactgctcatggtcttttcaacttccccccagcagtgcggccagtcccattggaaatacacatccagggtgtggatatagcaaattttgaggcaagaatgcaagcaatggcaaagccaacatacactgccatcacacaacatgcaaagagtggtaagcctgccctggtgtttgtgccgacacggaagcatgcaaggttgactgcgttggacttgtgtgcatactcgagtgctgagggtggcggtacaccgttccttcttgggtctcaagatgagatggatactttcattggaggtgtcaatgaagaaacgcttaaaaatacgctgaggtgtggtgtgggctacttgcatgagggccttagtgaccttgatcaggaacttgtgactcagctctttcttggtgggaggatccaagtgtgtgttgcaagcagcacgatgtgctgggggagatcattgcctgctcatttggttgttgtgatgggaacccagtattatgatggtcgggagagtgctcatactgattatccaatcactgatctgctacagatgatgggtcatgctagcaggcctcttcaagacaactcagggaagtgtgttatattgtgccatgcacctcggaaggaatactacaagaagttcctatttgaggccttccctgtggagagtcatctccaccatttcttgcatgatcatatgaatgccgaggttgttgtgggtgtcgtagaaaacaaacaagatgcagtggactatctcacatggactttcatgtacaggcggctgaacaagaaccccaactactacaatctgcagggtgtaagtcacaggcatctgtcagatcatctttctgagctaatcgagacagtgttgaatgacctggagtcaagcaaatgtgtggctgtagaggaggatatgtacctgaagccgctcaaccttggtctcattgctgcgtactactacatcagctacaccactatcgaacggttcagttcgatgctaactcagaagaccaagatgaaaggcctcctggaaattctagcttcggcatcagaatatgcagagcttccaagtcgcccaggtgaagaggaatacattgagaggctagtccgtcaccagaggttttctattgacaagcccaagtatggcgatccacatgtcaaggccaacgccctgctgcagtcccactttgcaaggcacacggtggtagggaacctggcagccgaccaacgggagatcctcctttctgcccataggctgctcctggcgatggttgatgttatctccagcagcggatggctcactctggctctgaatgcaatggagctgagccagatggtgacgcaaggcatgtgggatcgtgactctgtgctgctccaactcccacacttcacgagggacctggcccggagatgccaggaaaatgaagcgaagcccatcgagagcatcttcgatctggctgagatgagcatcgatgagatgcgggacctgttgcagctgtcaaactctgagctgcaggatgtcgtcgtgttcttcaagcggttccccaacgtcgacatgacttacgaggtccgcgagggcgacgacataagggccggtgacaacgtgaccttgcaggtgactctggagcgcgacatgaccaacctgcccaactccgaggtcggcccggttcacgcccccaggttccccaagaccaaggaggaagggtggtggctggtggtcggcgacagctccaccaagcagctgctggctatcaagagggtcaccctccagaagagggcccgtgtgaagctcgagttcaccgccgccgcggagccagggacgaaggactacatgatctacctgatgtcggactcgtacctcggctgcgaccaggagtacgagttcaccatcgacatcaaggaagctggaggcgactaatttcaaacacccaaaactcttttttatactgggtttttgctcttatgtagacaatattatgtgacctggaacttatcatctttttgtctgtaatgtaacacctgaagtttagctttgattcagtgtaacatgatgcacacgtacgttattgtgtttttgtatggcgacgaggaggatctacactagttgcggtttgcacttat

SEQ ID NO: 3639 - DNA, 6261 bp, Secale cereale
ccccatctccagcgccatgttcgaccagttcgtctccattgggaagctcatcactgatttccatgacgccagcgaccctgctgctgccccttctggtgatggtggggacgcgaccatggatgatgatatcggagttgctgtcgagttcgaggaggatgaggatgatgaggaaagtgattttgatcaggtgcaagatgacttggatgacgatgatgatgatgtggctgagttgaaccgtcctggaggtatgcagatgggcggagagttggatgacgatgatatgcagaactccaacgaggggctgaacataaacgtgcaggacattgatgcttactggctgcagaggaagataacacaggcatacgaagatattgatccccagcagagccagaagcttgccgaggagatattgaagataattgctgtgggtgatgacagagatgtcgagaatcgccttgtcatggagttggactatgagaaattcgatctcattaagttggtactgcgcaaccggttcaagattgtctggtgtacccgcttggccagggctgaagatcaggaagagcggaagaagatagaggaagagatgatggataacccaagcctagccccaatattggagcagctacatgcaacgagagcctctgcaaaggaaaggcagaagaatctggagaaaagtatcagggatgaggccaagaggcttcttaacaatgacagtgctggtgctgatggtccaagggagcgtcgggcagttgaccgggatacggagagtggatggctaaagggccagaggcagctgcttgatctcgatagcctctccttccaccaaggcggtctcttgatggccaacaagaagtgtgaacttcctgagggatcattcagaacccctcataaggggtatgaggaagtccatgtgccagcgttgaaacctaggccatacggaactggagagaagattgtgaagatatctgatatcccagggtgggcacaaccggcttttgctggaatgcagcaactgaacagggtccagagcaaggtttatgatactgcccttttcaaaccagacaacatccttctctgtgctccaactggtgctggtaaaaccaatgtcgccgtgcttacaattcttcaccagatcggtttgcatatgaaggatggtgagtttgataacagcaagtacaaaattgtctatgtggccccaatgaaagctcttgttgctgaagttgttggaaacttgtcggcacggcttaaagacttcaatgttaatgttagggagctcagtggagaccagaacctgacaaagcaacagattgatgatacacagatcatcgtcaccacacctgagaagtgggatattgtcacgaggaaatctggggacagaacatacactcaaatggtaaagcttctgatcatcgatgagatccatctgcttcatgacaacagagggcctgtcctggagagtattgtttctagaacagtacgtcagattgagacgaccaaggaacatattcgcctagttggcctctctgcaactcttccaaactatgaagatgttgctgtattcctgcgtgttcgctctgagggtctcttccattttgataacagttaccggccttgccctcttgctcagcagtacattgggatcactgtgaggaagccactgcagaggtttcagttgatgaatgagatctgttatgagaaagtaatggcttctgctggtaagcatcaagtgcttatttttgtgcactccaggaaggagacatcgaaaactgctcgggccatcagagatactgccttggcgaatgatacattgactcgctttctgaaggatgagagtgcgagccaggagatccttggcagtcatacagatattgtcaaaagcagtgaccttaaagaccttttgccgtatgggtttgctattcatcatgctgggatggcaagggtagaccgtgaacttgttgaggaactttttgctgataagcatatacaggtcctggtttcgacagccacccttgcatggggtgtcaacttgcctgcacatactgttattataaagggcacacagatttataatccggaaaaaggtgcttggacagaattaagtcctctggatgtcatgcagatgcttggtcgtgcaggtaggcctcagtatgacacacacggagagggaataatcttaactggccacagtgaattgcaatactacctctcccttatgaatcaacagctgcctattgagagtcagttcatatccaagttggcagatcagttaaatgcggagattgttctgggtactattcagaatgctcgggaagcatgctcttggcttggctacacttatctctacatccggatgctgcggaatccaacgctgtatggcttaccagcagatatcatggagacggacaaaacgctagatgagaggagagctgacttggtgcactctgctgcaaatttgctggataggaataatttgataaagtatgacaggaaaacaggatactttcaggttactgaccttggaaggattgccagttattactacattagtcatgggactatttcgacatacaatgaatatctgaagcccacgatgggtgatattgagctgtgtcggttgttctctctaagtgaagagtttaagtatgttagtgtcagacaagatgagaagatggagctggcaaagcttttggatcgtgtgccaattcctgtaaaagagagtttggaggagcccagtgcaaagatcaatgtgctgttgcaagcatatatatctaggttgaaactggagggcctctcccttggttctgatatggtctacatcagacagagtgctggccgacttctacgggcactttttgagatagttctgaagaggggatgggctcagctagcagagaaggctctgaatctttgcaagatgattgataagcagatgtggagtgtccaaacacctttgcgtcagtttcctggtattccaaaggaaattctgatgaaactggagaaaaaagaattggcctgggagaggtactatgacctgtcgtcgcaggaaattggtgaactaatcaggtttccaaagatggggaagcagctgcacaggtgcatccaccagttgccgaagttgaacctttctgcccatgttcaacccattactcgcacagttttgggtttcgaactgactataacacctgatttcctatgggatgataaggtacatggatatgttgagcctttctgggttatagtcgaggacaatgatggagagtacattcttcaccatgagtacttcatgcttaagagcaatacgtggatgaagatcacacacttcactttacagttgccgatatatgagccactgcctcctcagtattttatacgtgttgtatctgacaagtggcttggttctcagacgattctccctgtttgctttaggcacttgattcttccagaaaaatatgctccaccaactgaattgcttgatctgcagccactacctgtcactgcattgaggaatgcacgatatgaaggtctttatagtgcttttaaacatttcaaccccatccagactcaagtgttcactgtcttgtataatagtgacgacagtgtattggttgctgcaccaactggtagtgggaagactatatgtgcggaatttgctatactgaggaaccaccagaaggctgtatctggggaaaccacgatgcgtgttgtgtatatagcacctattgaggctctggccaaagaaaggtacagagactggtcaaagaaatttggtgaatttgcccgtgtagttgagctaacaggcgaaactgctgctgatttgaaacttcttgacaaagggagatcattattagtactcctgaaaagtgggatgcactttctcgccggtggaagcagaggaaacctgtccagcaagtcagtttatttattgttgatgagcttcatctaattggatctgagaagggacatgttctggaaatagttgtctctcggatgaggcgtatttcaagtcatattggcagtaacatccggattgtggcgctttcggcatcacttggaaatgctaaagatcttggagaatggattggcgctactgctcatggtcttttcaacttccccccagcagtgcggccagtcccattggaaatacacatccagggtgtggatatagcaaattttgaggcaaggatgcaagcaatggcaaagccaacatacactgccatcacacaacatgcaaagagtggtaagcctgccctggtgtttgtgccgacacggaagcatgcaaggttgactgcattggatttgtgtgcatactcgagtgctgagggtggtggtacaccgttccttcttgggtcccaagatgagatggatactttcattggaggtgtcaatgaagaaacgcttaaaaatacgctgagatgtggtgtgggctacttgcatgagggccttagtgaccttgatcaggaacttgtgactcaactctttcttggtgggaggatccaagtgtgtgttgcaagcagcacgatgtgctgggggagatcattgcctgctcatttggttgttgttatgggaacccagtattatgatggccgggagagtgctcatactgattatccaatcactgatctgctacagatgatgggtcatgctagcaggcctcttcaagacaactcagggaagtgtgttatattgtgccatgcacctcggaaggagtactacaagaagttcctttttgaggccttccctgtggagagtcatctccaccatttcttgcatgatcatatgaatgccgaggttgttgtgggtgttgtagaaaacaagcaagatgcagtggactatctcacatggactttcatgtacaggcggctgaacaagaaccccaactactataatctgcagggtgtaagtcacaggcatctgtcggatcatctttctgagctaatcgagacagtgttgaatgacctggagtcaagcaagtgcgtggctgtagaggaggatatgtatctgaagccgctcaaccttggtctcattgctgcgtactactacatcagctacaccaccatcgaacggttcagttctatgctaactcagaagaccaagatgaaaggcctcctggaaatcctagcttcagcatcagaatatgcagagcttccaagtcgcccaggcgaagaggaatacattgagaggctagtccgtcaccagaggttttctattgacaagcccaagtacggcgatccacatgtcaaggccacgcctgctgcagtcccactttgcaaggcacacggtggtagggaacctggcagctgaccagcgggagatcctcctttctgcccactagactgctcctggcaatggttgatgtcatctccagcagcggatggctcactctggctctgaatgcaatggagctgagccagatggtgacacaaggcatgtgggatcgtgactctgtgctgctccaactgccacacttcacgagggacctggcccggaaatgccaggaaaatgaagggaagcctatcgagagcatatttgatctggctgagatgagcatcgatgagatgcgggacctgctgcagctgtcaaactctgagctgcaagacgtcgtcgagttcttcaagcggttccccaacgtcgacatgacttacgaagtccgcgagggcgaggacataagggctggtgacaacgtgaccttgcaggtgactctggagcgcgacatgaccaacctgcccaactccgaggtcggcccggttcacgcccccaggttccctaagaccaaggaggaaggctggtggctggtggtgggcgacagctctaccaagcagctgctggcgatcaagagggtggcgctccagaagagggcccgtgtgaagctcgagttcaccgccgccgcggagccagggaggaaggactacatgatctacctcatgtcggactcctacctcggctgtgaccaggagtacgagttcaccgtcgacatcaaggaagctggaggcgactgattttgaacacctaaaactcttctttgtactcggttttttgctcttatgcagagattgttatgtgacctggaacttatcatcatcctcttgtctgtaatgtaacacctgaagtttagctttgattcagtgtaacctgatgcacacgtaccttattgttcttttgtatggcaacaagaggatctgcactacttgcttcttggtctgatttttcgattaatatatgaactgattcataaccattactgcaacgattataatagaa

SEQ ID NO: 3640 - DNA, 7326 bp, Musa acuminata
cgggaaccgagactaaaacctatcggcctcccctctcctcctttctccctcgtctacgtcccgtcggcgctgctgcgtccccacccgtttcgaatcggcgtcctcccctcggttttcttctctggcgactgccatcgatttcttcactctgcgttcggcaagcttcttgaggtcttttagccatggcccacctgggtggtggtgctgaggcccatgctcggttcaagcagtatgagtaccgtgccaattccagccttgttctgaccactgactcccgtccccgtgacacccatgaacctaccggagaacctgagtctctgtgggggaagattgatcccaagagttttggcgaccgggctttccgtggcaagccgctcgagctcgaggaaaagatcaagaagtcgaaaaagaagaaggagcgggagccagcactcgaacccgaacagaagaaagacagcaagcggcgccgcattcaggaggagagtgtgctctccctcacggatgatgccgtgtaccaacctaagactaaggagactcgtgcagcttatgaagcgctgctaagtgtgatccagcaacagtttggtgggcagccacaggatattcttagtggggcagcagatgaagtcctggtggtattgaagaatgagaaaataaagaaccctgacaaaaagaaggagattgagaagctcttgaatcccatttccaatcaagtattcgatcagcttgtatcaattggacggctgatcacagactatcaggatgccggtgttgctgcagattctgctgctgcaaatggtaatggcgaggcgttagacgacattggtgttgcagtcgagtttgaggaggatgaggaggaggaagagagcgattacgatcaggtacataagactccacctggttttattattaacttgtcagtggagattgtgttttttgcaattcatattatccttgttcaatatatgggcaggtacaagaggaatcggaggatgatgacgatggccaggaatcaaatgctgctggtgctatgcagatgggtggaattgatgatgaggacatggaagaagctaatgagggtcaaaccattaacgtccaagacattgatgcttactggcttcaaaggaagatatctcaggcttatgaggagattgatccacaacaaagccagaaacttgcagaagaggtgctaaaaatacttgccgaaggggatgatagggatgttgagaacaggctcgtaatgctgttggactatgacaagtttgagctcatcaaattgcttctgcggaaccggctcaagatagtttggtgtactcgattggccagggcagaggatcaagaccagcgaaagaagatcgaagaagagatgtcaaatatgggtccaactctcaccacgattttggagcagctgcatgccactagagcatctgcaaaggagcgacagaagaatttagagaagagcataagagaggaggctaggcgattgaaggatgaacatggtggtggggataatgacagggataggagggttgttgatagagacacggatagtgggtggttgaaggggcaatgtcagctgcttgatcttgatagcattgcatttcatcagggtggccttttgatggctaataagaagtgtgagcttcctccaggatcatatagaactcctcacaagggctacgaggaagttcatgtgccagcactaaaaccaaaaacattctcaccagaagagaagcttgtgaaaatatctgacttgcctgattgggcacagccagcttttgaagggatgaagcagctgaacagagtacaaagtatggtctacaaaactgcttttacctcacctgagaatatactgttgtgtgcgccaactggtgctgggaaaaccaatgttgccatgctggccatcttacatcagattggcttgcataggagggatggagttttagacaacagtaagtacaagattgtttatgtggctccgatgaaagctctggttgctgaagtggttgggaatctgtcccatcggctgaaatcttataatattgttgtgagggaactcagcggagaccaaaacctcactcgccagcagattgaagagactcagatcattgtcaccactccagagaaatgggatattgtcacaagaaagtctggagataggacctatacacagctcgtgaagctccttataattgatgagattcatcttcttcatgataaccgtggacctgtccttgaaagtattgtcgctaggacacttaggcagactgaagcgaccaaggagttgattagactggttggtctatcagccactctcccgaattatgaagatgtagcattgttcttacgtgtcaccaagccgagtggaattctccattttgacaatagttacagaccctgccctcttgcacaacagtatattggtatcacaataaaaaaaccattgcagcgatttcagttgatgaatgaaatttgttacgaaaaggttatggctgctgctggaaagcatcaagtgcttatctttgttcattcaaggaaagaaacagctaaaactgctcgtgcaatccgagacactgctcttgccaatgacacattgagtcggtttttaaaggatgacagtgcaagccgtgaaattcttcaaagtcaaactgaatttgttaaaagcaatgatcttaaagatctcttgccatatgggtttgctatccatcatgcaggaatggcaagggtggatcgtgatcttgttgaggagcttttttctgatggacatgtacaggtgttggtatcgacagccacccttgcttggggtgttaatctgccagcacacacggtcattataaaaggcacccagatatacaatccagagaaaggagcttggactgaacttagtcctcttgatgtcatgcagatgcttggtcgtgcaggaaggcctcagtatgactcttatggagaaggcataattctaacaggtcacagtgagctgcagtactatctatcccttatgaaccagcagctgccaattgagagtcagtttgtgtctaaattggctgaccaattaaatgcagagattgttttggggacagttcagaatgccagagaggcatgtaactggattgggtacacttacctttacgtacgcatggttagaaacccaactttatatggattgtctgcagacatcctggagagggacaaactgttggaggaaaggcgagctgatctgattcatactgctgcaaatattttagataaaaacaatttagtcaagtacgacaggaagagcgggtactttcaggctacagatctgggcagaattgcaagttattattatatcactcatgggacaatatctacgtacaatgagtacctaaagccaactatgggtgacatagagcttttccgattgttctcccttagtgaagagtttaaatatgtgactgtgcggcaggatgagaagatggagttggcaaagcttttggatcgtgtgcctattcctgtcaaagaaagcttggaggagcctagtgctaaaatcaatgttctgctgcaagcatacatatcacagctgaaacttgaggggctttccctgacatctgatatggttttcattaagcagagtgcaggccgtcttataagatctctgttcgagatcgtcttaaaaaggggatgggctcaattggctgagaaggcattaaatctttgcaagatggttgacaagcgcatgtggagcgttcagactccgctgcgccagttcacaggtataccaaatgaaattttgatgaaattggaaaagaaggatctgtcttgggaaagatattatgacctgtcatcccaggagattggagagttgattcgttaccccaagatgggtaggcagcttcataaatgcatacaccagttgccaaaactgaaccttttagcacatgtccaacccatcacccgcactgtcttgggttttgaattgactataacacctgattttcagtgggatgatgctgtgcatggatatgtggaaccattttgggttattgtcgaggacaatgatggtgaatatattcttcatcatgagtatttcatgcttaagaaacagtacattgatgaagatcacactctgaacttcactgttcccatttacgagccgctgccacctcaatatttcattcgtgtagtatcagacaagtggcttggttctcaaactgttttacctgtctgttttaggcatctgattctaccagaaaagtacccccctgcaactgaattgctggatttacaacctctgccagttactgctttaagaaatcctgcatatgaagctctttatgatgcattcaaacattttaatcctatccagacacaagtgttcacggttttgtacaacacagatgacaatgtcttggttgctgcccctacgggcagtgggaagactatatgtgctgagtttgcattgcttcggaatcatcaaaaaggtcctgatagcatcatgagggctgtgtacattgctccgattgaagctgtcgcaaaagaaaggtaccgtgattgggaagagaagtttgggaaacgtctgggaattcgtgttgtggagttgactggagaaactgctaccgacttgaagctgcttgagagaggacagatcataatcagtactccagaaaaatgggatgcactctctcgtaggtggaaacaacgtaagcaagtccagcaggtcagcctcttcattgtagatgagcttcatttaataggtggagaaatgggtcctatcttggaaataatcgtctctaggatgagacgtattgcaagtcacattggtagcaacatccgtatcgtagcactttcagcatctcttgcaaacgctaaggatcttggtgaatggataggtgctacatctcatggtttgttcaattttccacctggtgttcgtccagtgcctttggagatacatattcaaggtgtggatatatcaaattttgaggcaagaatgcaagcaatgacaaaacctacatatactgctattgttcagcattcaaagaatgggaaaccagccctggtctttgtacccacaagaaagcatgcacggctgactgcactggatctgtgtacttattcacatgctgaccgtggagagaggccttcttttcttcttggttcgggggaagaaatgaacacttttatatccgggatcaaggatgataccctgaaagggacacttgctcttggtgtcggctacttgcatgaaggtctcaatgagtttgatcaagaggttgtaatacaattgtttcttggtggaaggattcaagtttgtgttgcaaccagtttgatgtgctggggtcggtcattgccttcccacttggttgtcgttatgggaacacaatattatgatggcagagagaatgctcacactgattatccaatcactgatctgctgcagatgatgggccatgccagtagacctctcaaagataactctggtatatgcgtcatactatgccatgctcctcgtaaggagtattataagaagttcctctatgaggctttcccagtcgagagccatttgcataatttcttgcatgatcatatgaatgcggaagttgttgttggagttacagagaataagcaagatgctgtggattatcttacgtggactttcatgtatcggaggcttactaagaatccaaactactataatctgcagggtgtgagtcacaggcatctttctgatcacctttctgaactagtggagaatgttttgagtgacttggaatcgagcaaatgtgtggctattgaggaggatatgtacctgaaacctctgaaccttggcttgattgcttcatattattacattagttacaccactatcgagcgattcagttcttctttaacatccaaaactaagatgaaaggtctactggatattttggcatcagcttcagagtattcacagcttcccatccgacctggcgaggaagaattgatcaggaagttgattaatcaccagaggttctcctttgagaatccaaaatgcactgaccctcatgttaaggcaaatgtgctgttacaagctcacttctccagacacacagtggttgggaaccttgcggcagatcagcgagaggttctcctttctgctcataggctgcttcaagcaatggttgatgttatctcaagcaacggatggcttagccttgccctttctacaatggagctgagtcaaatggtaacacagggcatgtgggagcgtgattctatgcttttgcaaattccacatttcacaaaggagttagccaagagatgccaagaaaatccagggaggagtattgagactgtttttgatcttgtggagatggaagatgatgaaaggcgggatctgctgcaaatgttagattcccagttgcttgatattgctcgattttgcaaccgctttcctaacattgatatgacctacgaggtgctggacgatgatgatgttaggcccggggaaaatgtgacattgcaggttacgctggagcgtgatctcgaggggcgtgctgaggttggaccagtggatgcacccagatatccaaaggccaaagaagaagggtggtggcttgtggttggtgataccggcaataatcagttacttgccatcaaaagagtagcattgcaaaggaaagcaaaagtcaagcttgtctttacagctcctgcagaggttgggaagaaggcatttaccatttacttcatgtgcgattcatatttgggctgtgaccaggaatataattttaacattgatgtcaaagaaggcggagaagatgggaatagaagtgactaaaagttcatctgctgtcggagcctatcttctttatgctttctcattaattggccttggggtatagtgtgttagcttatgttgttcctgttacttaatgcttctctccggtaagttgcttcgtcggaatcctctttcttcgccattcagcttggacatggcagttactaggcataagttgtacttttgataacctgttgtcctggatgaatacttgatgcctctagcttatctatgaaaacataatcttttcaccgacgatttgtgcaatactgacatgatgatgtgtttgtggcagttgtggcgaataattttttttgttatagagcaaataacaaagagaatgaaaaggaacagatgaaagagaactgttcatggatcctttcatgtcctttgcaggtgccttggagttgatatccatctaagagagtcatagttatatagctcccgagttcggcgatcagtatgatttctcaaccctatttcacttcttaaactggatatctcatctactcttttgctagacacgaccatca

SEQ ID NO: 3641 - DNA, 6697 bp, Oryza sativa
catggccaagccgggtagcggcggtggcgccgaggcgcacgcgcgttcgaggaagtacgactacgtcgagaactcgaacctcgtgctcggctccggctccggctcgcgcccccgtggcggcgcggacgagcacaccggcgagcccgagacgctccggggcaggatcgacccgaggagcttcggcgaccgcgccgtccaggccaagccccccgtcgagccgccgcgcaggaggaaggcgcgcgacgccgcggaccacgacatcggccaccgcctcgacgccaagcgcaggcgccgcgccgcctccgcctgtaccgcgcagcgcgaggtcagcgtgctcacgctcatcgacgacgtcgtgtacaggccccggaccaaggagacgcgagccgcctacgaggccctgctcagcgtcatccagcggcagctcggcggccagcctcctgacgtgcttggcagcgccgccgacgaggtgcttgccatcctcaacaatgacaagatcaagagccctgagaagaagagggggatcgacaagttcctcgaccccatctccgaccagatgttccaccagttcgtctccatcggtaagctcatcacagattttcatgatactgcagtttgtgattcagctagtgaactggatgaaaatttcggcgttgctgttgagtttgaacagaacgaagacgatgagggaagtgattctgatcaggtactagatgatttggatgaggacgacggcgacaccatgctgaatgctgctggtgccatgcaaattggtgatgagttagacgatgatgatatgcataactccaatgaggagctggccataaacgcacaagacattgatgcttactggcttcagaggaaggtatcacaggcatatgaagatattgatccgcaggttagccaggagctttctttggagatcatgagttttctttctgagagtgacgacaaggatgttgagaatcggcttgtcacgctattgggctatgacaattttgatttcatcaaattgctggtgcggaaccgactcaagatattctggtgtacttgtttggcaagggctgaaggtcaggaaaagcggaagatgatagaagagaatatgctgagtgacccaacattaagtccaatattggagcagctgcatgcaacgagggtgtctgcaaaagataggctgaagaatatggagaaaagcatcagggatgaggccaagaggcttaccgaaaaacaaaatgctggcattaatggtgcgagggatcaaagggtagttaagcgggatatggagagtggatggttgaaaggccagaagcagctgcttgatcttgagaacctaaccttccaccaaggtggtctcttgatggttaacaagaaatgtgaacttccaccaggatcatttagaacccctcataacgggtatgaggaagtccatgtgccagcactgaaagctaagccatatgaaaatggagagaaggttgtcaagatatctgatatgccagactgggctcaaccagcttttgctgggatgacacagctgaataggattcaaagcaaggtttatgatactgcccttttcaaaccagataatattattctctgtgcaccaacaggtgctgggaaaaccaacgtggctgtgcttacaatccttcagcagattggcttgcacatgaaagatggagagtttgacaataccaaatacaaaattgtgtatgtagccccaatgaaagctttggttgctgaagttgttggaaatttgtcagcacggctgaaagagtacaatatcactgtaagggaactcagtggagaccagaacttaaccaaacaacagattgatgaaacacagattattgtcactacacctgagaaatgggatattgtcacaagaaaatcagagggcctgttctggagagcattgtttagatcagtcaggcagactgaaacaaccaaggaacatatccgtctagttggtctctcagcaactcttccaaactatcaagatgttgcagttttcttgcgtgttcactctggtggtctcttccattttgataacagctaccgaccttgccctcttgctcaacaatacattgggatcactgtgaagaagcccttccagaggtttcagttgatgaatcagatttgctatgagaaggttatggctgctgctggaaagcatcaagtgcttatatttgtgcactcgaggaaggagacagccaaaactgctcgtgccatcaaagatattgcattatctaataacaaactgacctgctttccaaaggttgagagcgcgagcctagagattcttgccgatcatgcaaatcatgtgaaaagcaatgatcttaaagatcttttgccgtatgggtttggtattcatcatgctgggttgacaagggtagaccgtgagctcattgaggggctttttgctgataaacatttacaggcgctcgtttcgacagcgacccttgcatggggtgtcaatttgcctgcgcacactgtaataataaagggtacccaggtttacaatccggaaaaaggtgcttggacagaactgagccctctggatgtcatgcagatgcttggtcgcgcgggcagacctcagtatgatacacatggagagggaataatactaactgaacaaagtgaattgcagtactacctgtctctgatgaatcagcaactgcctattgagagtcagttcatatccagattggctgatcatctgaatgctgagatcgttctggggactattcagaatgttcgggaggcatgcacctggcttggctacacctacctctacatcaggatgctccggaatccaacgttgtacggtttaccagcagatattatggaaacagacaatactctagatgaaaggagagttgacttggtacacgctgctgcaaatatactggattggaacaatttgataaagtatgacaggaaaacaggatattttcaggtaactgacctgggaaggattgctagttattactatgttagtcacaggactatctcaacatacaatgagtgcctgaagcctacaatgggtgatattgagctgtgtcgactcttttcactgagtgaagaatttaagtatgtcagtgttagacaggatgagaaaatggagttggcaaagcttttcaattgtgtgcctattcctgtgaaagagagcttggacgagcccagtgcaaagatcaatgttctactgcaagcatatatttctaggctggaactggagggtctttcccttagttcagatatggtctacatcagacagaatgctggccgtctcctacgagcgctgtttgagatagttttgaagagaggatgggcccaactagcggagaaagcgttgaatctttgcaagatgattgataagcatatatggaacgtccaaattcccctgcaccagtttccaagtattccaaaggaaatcttaatgaaactggagaaaaaagaattggcttgggagaggtactttgacctatcatcacaggaaattggtgagctaattcgtaacccgaagatggggatgcagctgcacaagtgcatccaccaattaccaaagctgaacctttcagcccatgttcaacctattactcctacggttttgggttttgaactgactataacagctgatttccaatgggatgatgaattgcatggatatgtggagcccttctggcttattgttgaggacaacggtggcgataacattcttcaccatgagtacttcatgcttaagaaacaatacgtggatgaagatcatacacttaacttcacagtgccaatatatgagccactgccccctcagtactttatacgcgtagtatctgataagtggcttggttctcagacaattcttcctgtcagttttaggcatttaactcttccagaaaaatatgctccaccaactgaattgattgatctgcagccactacctgttactgccctgagaaatgcacgatatgaaagcctttactgtgcttttaaacatttcaaccccatccagactcaagtgttcactgcctcgtacaacagtgatgacagcgtgttggttgcggcgccaacaggcagtggaaagaccatatgtgcagagtttgctattctaagaaaccatcagaaggctgtatctggtgacagcaacatgcgtgttgtgtatgtagctcctattgaagctcttgcaaaagaaagatataaggattgggagagcaaatttggagaattggcgcgggtagttgagctaacaggcgaaacagcagctgatttgaagcttcttgataaaggggagattataatcagtactgctgagaagtgggatgcactctcacgccgatggaaacagcgaaagaatgtgcaacaggtcagtttatttatttttgacgagctccatctgattggatctgaaaatgggcatattctggaaatcatcatctctaggatgaggcatatggcgaatcatattggtagtaacattcggattgtagcgctttcagcatcccttgcaaatggtaaagatcttggagaatggattggcacctcctctcatagccttttcaacttccctccagcagtgcgaccactgccgttagaaattcacattcagggttgggatgtagcaatttttgaggcaaggatgcaggcaatgtcaaagccaacatacactgctataacccagcatgcaaagcatggtaagcctgccctggtgtttgtaccaacacataagcatgcaaggttgaccgcagtggatttgtgtgcacactcaagtgctgagagtggtggaacacctttccttcttgggtcagaagacgagatggatactttcactagtggtgtcaatgatgaagcacttaaatacactctgaaatgtggtgtaggctacttgcatgagggcctgagcgacttcgatcaggaacttgtaactcagctctttcttggtgggaggatccaagtgtgtgttgcaagcagcaaaatgtgctggggaagatcattgccctctcatctggttgttgtgatgggaacccagtattatgatggccgggggaacagccatactgattatccagtcactgatctgttgcaaatgatgggccatgccaacaggcctcttcaagatgactctgggaaatgtgttatattgtgctatgcgcctcgcaaggaatactacaagaagttcctttttgaggccttccctgttgagagccatctccagcacttcttgcatgatcatatgaatgccgaggtggtagctggtcttatagaaaacaagcaagatgccgtggattatcttacttggaccttcatgtaccgacggcttgcgaagaaccctaactactacaatctgcaggatgtgagccacaggcatgtatcagaacatctctctgagctggttgagacagtgctgaacgacctggaatcaaccaattgtttggctatcgaggaaaatatttacctgaagaccctcaaccttggtctcattgcctcgtattactacgtcacctacacgactattgagcgattcagttctatgctaactcagaagaccaagttgaaaggcctcctggagattctagcttctgcctcagaatatgcagatctccccagtcgccctggtgagcaaaaatccattgagaggcttgttcatcaccagagattttctgtcgagaagaaagtcaggtatgacgatccacatgtcaaggccaacgcactgctgcaatgccatttctcaaggcgcacggtggaaggtgaccttgcagctgaccagcgggagattctccttcctgctcatagattgctccaggcactgatcgatgtcatctccagcaacggatggctcaccctcgctctcaacgcaatggagctgagccagatggtgacacagggcatgtgggatcgcgattccgtgctgcttcagcttccacacttcaccgaggagttagcccggagatgccaggagaacgaaggcaaggccatcgagaccatcttcgatctggctgagatgagcacgcatgagatgcaggatctgctgcagctaccaagctcccagctgcaggacatcgtcggattcctcaggcggttcccaaacatcgacatggctttccaagttcttgaaggcgatggtggcagtgtgaccgtgcaggtgacgctagagcgcgagatggcagacctgctgcaatctgaggctggtccagtccatgcccccaggttcccaaagcccaaggaagaaggatggtggctggtgattggtgatcgctccaccgaccagttgctggcaatcaagagggtcaagctccagaagagggctcgagtgaagctcgagttcgctgcccctgcagaagcagggagaaaagattacatggtttacttgatgtctgattcctatctgggctgcgaccaggagtacgagttcgccgtcgatgtcaaggatgctggaggggattgatcttcgagaatcgagatggagatagctttgtccccaggtattctatggaacttgttcatttcttgagatggaaactggattcttggtacgttgcaattgttagatagcgttcgactcaaatatctccacggctttcccttttctgtatgtatatacactttgtgtatctttacctgcttttcgccgggcctatctttacctgcttttcagtgtaaatgaacgatgcaagcgaaatattacaagcaacaagttctttgcgtg

SEQ ID NO: 3642 - DNA, 6435 bp, Oryza sativa
atggccaagccgggtagcggcggtggcgccgaggcgcacgcgcgttcgaggaagtacgactacgtcgagaactcgaacctcgtgctcggctccggctccggctcgcgcccccgtggcggcgcggacgagcacaccggcgagcccgagacgctccggggcaggatcgacccgaggagcttcggcgaccgcgccgtccaggccaagccccccgtcgagccgccgcgcaggaggaaggcgcgcgacgccgcggaccacgacatcggccaccgcctcgacgccaagcgcaggcgccgcgccgcctccgcctgtaccgcgcagcgcgaggtcagcgtgctcacgctcatcgacgacgtcgtgtacaggccccggaccaaggagacgcgagccgcctacgaggccctgctcagcgtcatccagcggcagctcggcggccagcctcctgacgtgcttggcagcgccgccgacgaggtgcttgccatcctcaacaatgacaagatcaagagccctgagaagaagagggggatcgacaagttcctcgaccccatctccgaccagatgttccaccagttcgtctccatcggtaagctcatcacagattttcatgatactgcagtttgtgattcagctagtgaactggatgaaaatttcggcgttgctgttgagtttgaacagaacgaagacgatgagggaagtgattctgatcaggtactagatgatttggatgaggacgacggcgacaccatgctgaatgctgctggtgccatgcaaattggtgatgagttagacgatgatgatatgcataactccaatgaggagctggccataaacgcacaagacattgatgcttactggcttcagaggaaggtatcacaggcatatgaagatattgatccgcaggttagccaggagctttctttggagatcatgagttttctttctgagagtgacgacaaggatgttgagaatcggcttgtcacgctattgggctatgacaattttgatttcatcaaattgctggtgcggaaccgactcaagatattctggtgtacttgtttggcaagggctgaaggtcaggaaaagcggaagatgatagaagagaatatgctgagtgacccaacattaagtccaatattggagcagctgcatgcaacgagggtgtctgcaaaagataggctgaagaatatggagaaaagcatcagggatgaggccaagaggcttaccgaaaaacaaaatgctggcattaatggtgcgagggatcaaagggtagttaagcgggatatggagagtggatggttgaaaggccagaagcagctgcttgatcttgagaacctaaccttccaccaaggtggtctcttgatggttaacaagaaatgtgaacttccaccaggatcatttagaacccctcataacgggtatgaggaagtccatgtgccagcactgaaagctaagccatatgaaaatggagagaaggttgtcaagatatctgatatgccagactgggctcaaccagcttttgctgggatgacacagctgaataggattcaaagcaaggtttatgatactgcccttttcaaaccagataatattattctctgtgcaccaacaggtgctgggaaaaccaacgtggctgtgcttacaatccttcagcagattggcttgcacatgaaagatggagagtttgacaataccaaatacaaaattgtgtatgtagccccaatgaaagctttggttgctgaagttgttggaaatttgtcagcacggctgaaagagtacaatatcactgtaagggaactcagtggagaccagaacttaaccaaacaacagattgatgaaacacagattattgtcactacacctgagaaatgggatattgtcacaagaaaatcagagggcctgttctggagagcattgtttagatcagtcaggcagactgaaacaaccaaggaacatatccgtctagttggtctctcagcaactcttccaaactatcaagatgttgcagttttcttgcgtgttcactctggtggtctcttccattttgataacagctaccgaccttgccctcttgctcaacaatacattgggatcactgtgaagaagcccttccagaggtttcagttgatgaatcagatttgctatgagaaggttatggctgctgctggaaagcatcaagtgcttatatttgtgcactcgaggaaggagacagccaaaactgctcgtgccatcaaagatattgcattatctaataacaaactgacctgctttccaaaggttgagagcgcgagcctagagattcttgccgatcatgcaaatcatgtgaaaagcaatgatcttaaagatcttttgccgtatgggtttggtattcatcatgctgggttgacaagggtagaccgtgagctcattgaggggctttttgctgataaacatttacaggcgctcgtttcgacagcgacccttgcatggggtgtcaatttgcctgcgcacactgtaataataaagggtacccaggtttacaatccggaaaaaggtgcttggacagaactgagccctctggatgtcatgcagatgcttggtcgcgcgggcagacctcagtatgatacacatggagagggaataatactaactgaacaaagtgaattgcagtactacctgtctctgatgaatcagcaactgcctattgagagtcagttcatatccagattggctgatcatctgaatgctgagatcgttctggggactattcagaatgttcgggaggcatgcacctggcttggctacacctacctctacatcaggatgctccggaatccaacgttgtacggtttaccagcagatattatggaaacagacaatactctagatgaaaggagagttgacttggtacacgctgctgcaaatatactggattggaacaatttgataaagtatgacaggaaaacaggatattttcaggtaactgacctgggaaggattgctagttattactatgttagtcacaggactatctcaacatacaatgagtgcctgaagcctacaatgggtgatattgagctgtgtcgactcttttcactgagtgaagaatttaagtatgtcagtgttagacaggatgagaaaatggagttggcaaagcttttcaattgtgtgcctattcctgtgaaagagagcttggacgagcccagtgcaaagatcaatgttctactgcaagcatatatttctaggctggaactggagggtctttcccttagttcagatatggtctacatcagacagaatgctggccgtctcctacgagcgctgtttgagatagttttgaagagaggatgggcccaactagcggagaaagcgttgaatctttgcaagatgattgataagcatatatggaacgtccaaattcccctgcaccagtttccaagtattccaaaggaaatcttaatgaaactggagaaaaaagaattggcttgggagaggtactttgacctatcatcacaggaaattggtgagctaattcgtaacccgaagatggggatgcagctgcacaagtgcatccaccaattaccaaagctgaacctttcagcccatgttcaacctattactcctacggttttgggttttgaactgactataacagctgatttccaatgggatgatgaattgcatggatatgtggagcccttctggcttattgttgaggacaacggtggcgataacattcttcaccatgagtacttcatgcttaagaaacaatacgtggatgaagatcatacacttaacttcacagtgccaatatatgagccactgccccctcagtactttatacgcgtagtatctgataagtggcttggttctcagacaattcttcctgtcagttttaggcatttaactcttccagaaaaatatgctccaccaactgaattgattgatctgcagccactacctgttactgccctgagaaatgcacgatatgaaagcctttactgtgcttttaaacatttcaaccccatccagactcaagtgttcactgcctcgtacaacagtgatgacagcgtgttggttgcggcgccaacaggcagtggaaagaccatatgtgcagagtttgctattctaagaaaccatcagaaggctgtatctggtgacagcaacatgcgtgttgtgtatgtagctcctattgaagctcttgcaaaagaaagatataaggattgggagagcaaatttggagaattggcgcgggtagttgagctaacaggcgaaacagcagctgatttgaagcttcttgataaaggggagattataatcagtactgctgagaagtgggatgcactctcacgccgatggaaacagcgaaagaatgtgcaacaggtcagtttatttatttttgacgagctccatctgattggatctgaaaatgggcatattctggaaatcatcatctctaggatgaggcatatggcgaatcatattggtagtaacattcggattgtagcgctttcagcatcccttgcaaatggtaaagatcttggagaatggattggcacctcctctcatagccttttcaacttccctccagcagtgcgaccactgccgttagaaattcacattcagggttgggatgtagcaatttttgaggcaaggatgcaggcaatgtcaaagccaacatacactgctataacccagcatgcaaagcatggtaagcctgccctggtgtttgtaccaacacataagcatgcaaggttgaccgcagtggatttgtgtgcacactcaagtgctgagagtggtggaacacctttccttcttgggtcagaagacgagatggatactttcactagtggtgtcaatgatgaagcacttaaatacactctgaaatgtggtgtaggctacttgcatgagggcctgagcgacttcgatcaggaacttgtaactcagctctttcttggtgggaggatccaagtgtgtgttgcaagcagcaaaatgtgctggggaagatcattgccctctcatctggttgttgtgatgggaacccagtattatgatggccgggggaacagccatactgattatccagtcactgatctgttgcaaatgatgggccatgccaacaggcctcttcaagatgactctgggaaatgtgttatattgtgctatgcgcctcgcaaggaatactacaagaagttcctttttgaggccttccctgttgagagccatctccagcacttcttgcatgatcatatgaatgccgaggtggtagctggtcttatagaaaacaagcaagatgccgtggattatcttacttggaccttcatgtaccgacggcttgcgaagaaccctaactactacaatctgcaggatgtgagccacaggcatgtatcagaacatctctctgagctggttgagacagtgctgaacgacctggaatcaaccaattgtttggctatcgaggaaaatatttacctgaagaccctcaaccttggtctcattgcctcgtattactacgtcacctacacgactattgagcgattcagttctatgctaactcagaagaccaagttgaaaggcctcctggagattctagcttctgcctcagaatatgcagatctccccagtcgccctggtgagcaaaaatccattgagaggcttgttcatcaccagagattttctgtcgagaagaaagtcaggtatgacgatccacatgtcaaggccaacgcactgctgcaatgccatttctcaaggcgcacggtggaaggtgaccttgcagctgaccagcgggagattctccttcctgctcatagattgctccaggcactgatcgatgtcatctccagcaacggatggctcaccctcgctctcaacgcaatggagctgagccagatggtgacacagggcatgtgggatcgcgattccgtgctgcttcagcttccacacttcaccgaggagttagcccggagatgccaggagaacgaaggcaaggccatcgagaccatcttcgatctggctgagatgagcacgcatgagatgcaggatctgctgcagctaccaagctcccagctgcaggacatcgtcggattcctcaggcggttcccaaacatcgacatggctttccaagttcttgaaggcgatggtggcagtgtgaccgtgcaggtgacgctagagcgcgagatggcagacctgctgcaatctgaggctggtccagtccatgcccccaggttcccaaagcccaaggaagaaggatggtggctggtgattggtgatcgctccaccgaccagttgctggcaatcaagagggtcaagctccagaagagggctcgagtgaagctcgagttcgctgcccctgcagaagcagggagaaaagattacatggtttacttgatgtctgattcctatctgggctgcgaccaggagtacgagttcgccgtcgatgtcaaggatgctggaggggattga

SEQ ID NO: 3643 - DNA, 6611 bp, Brachypodium distachyon
atggaggacgcgggcgggggcgccgaggcgcgcgcgcgctcgaagcagtacgactacggcgccaactccaacctcgtcgttaacaccgcctcgcggccaccccgcgtcgcgcacgagcccaccggcgagcccgagacgctcaggggcaggatccgcgcgagcgatttcggcgaccgcgccgtccaaacaaggcctcccgagctcgacgagaagttgagcgacaaccgcaaaaagaaggagcgcgacgccgcctctgccgaccccgacctcccgtgccacgatgccaagcgcacgcgccgcgccgccgccgtgcagcgcgaggtcagcgtgctttcactcaccgatgacttcagatacaagcccaagaccaaggagacgcgggctgcctacgaggcgcttctcagcatcatccagcagcagtttggtgggcagcccctcgacgtgcttggtgatgccgctgatgaggtgcttgccgccctcaagaatgacaagatcaagattcctgacaagaaggagatcgagaagcttatcagccctaactcggatcagatgttcgaccagctagtctccattgggaagctcatcacagatttccgtgatgctgcggtcggcatgccttctagtgatggggcggacatgatgcctgatgacaatattggcgttactgttgagtttgaagaggacgaggatgataaggagagtaacttttgtcaggtgcaggatgagtcggatgaagatgatgttgttgaattgaacggtcctggagctatgcagatggatactgagttgtatgacgatgatatgcagaactctaacaggggctgaccatagacgtgcaagacattgatgcttactggcttcagaggaagatatcacaagcatacacagatattgacccccaacacagccagaagctcgcggaggaaatcttgaaggtgattgccaagggagacgacagggatgtcgagaatcggcttgtcacgctgctgggctacgaaagtttgatctcattaaattgctgctttgcaacaggctcaagattgtttggtgtaccttcttagccagggctgaaaatcaggaacagcgggagaatatagtctgagtaacccaagattggctccaatattggaacagctacatgcaacgagagcatgtacaacggagaggcagaagaatctggggagaagtatcagggatgaggcccagaggctcataaacaatgacagtgctagtgctgctggtgcgaggggtcatagggcagttgacggggatatggagagtggatggttaaaaggccagaggcagctgcttgatcttgaaaacctctctttccaccaaggtggtctcttgatgtccaacaagaaatgtgaacttcctccaggatcatatagaacccctcagaaagggtatgaggaagtccatgtaccagcattgcaagctaagacgtatgaatctgcagagaagattgtgaagatatctgatatggcagagtgggttcggccagcttttgctggcatgacacagctgaatacagttcagagtaaggtttatgatgctgccctttacagatcagataacatccttctctgtgctccgacgggtgctgggaaaaccaatgtggctatgcttacaattcttcagcagattggtttgcatatgaagtatggtgaatttgataatacaaagtacaaaattgtctatgtggccccgatgaaagctttggttgctgaagttgttcgaaatttatcagcacggctgaaagaatacaagtgtattgttagggagcttagtggagaccagtaccttaccaaacaacagattgatgaaacacagataattgtcactacacctgagaaatgggatattgtcacgaggaaatcaggagatagaacagagggcctgttctggagagtattgtttctagaacagtaaggcagattgagacaaccaaggaacatatccgcctggttggcctatctgcaactctccctaattatgaagatgttgcggtattcttgcgtgttagctctgatggtctcttccattttgataacagttaccggccttgccctcttgctcaacagtacattgggatcacagtgaggaagccactgcagaggttacagttgatgaatgagatttgttatgagaaggttatggctgctgctggtaagcaccaagtgcttatatttgtgcactcgaggaaggagacggcgaaaactgctcgttccatcacagacactgcattggctaatgacatgttgaccccctttctgaaagatgagagtgcaagtcaagaaattctttgtgctcatgcggaacttatcaaaagtaacgaccttgaagaccttttgccatatgggtttgctattcatcatgctgggttggcaagggtagaccgtgaacttgttgagaaactttttgttgataagcatatacagggtcctggtttcgacagcaacccttgcatggggtgtcaatctacctgcacacactgttattataaagggtacccaaatttacaatccggagaaggctgcttggacagaactaagtccactggatgtcatgcagatgcttggtcgtgcaggcaggccacagtatgacacacatggagaggggataatcataactggccacaacgaattgcagtactacctgtctcttatgaatcatcagctgcctattgagagtcaatttatatccagattggctgatcaattaaatgcagagattgttctgggaactattcaggatgcccgtgaggcatgctcgtggcttggctacacttacctctacatccggatgctccggaaccaacattgtatggtttacctgaagatatcttggagaaagacaaaacactggatgaaaggagagctgacttggtacactctgctgcaaatttgttggataggaacagtttgataaagtatgacaggaaaacaggatactttcaggttactgacctgggaaggattgctagttattactatgttagtcacgaaactatttcaacttacaacgaggacctgaagcctacaatgggttatattgagctgtgtcgattgttctctttgagtgaagagtttaagtatgttagtatcaggcaagatgagaagatggagttggcaaagcttttcgatcgtgcgccaattccagtgaaagagagtttggaggagtccggcacaaagatcaatgttctgctccaagcatatatttctaaactaaaactggatggtctctcccttggttctgatatgatctatatcagacagagtgctggccgtctcttgcgagcattgtttgggatagctttgaagagaggatgggctcaactagcagagaagactcttaatctttgcaagatgattgataagcagatgtggggtgtccaaactcctttgcgccaatttgctggccttccgaatgaaatcctgatgaaactggagaaaaaggaattggcctgggagaggtactatgacctatcatcacaggaaatcggcgagctaatctgttatccaaagatggggatgcaacttcacaagtgcatccaccagttgccgaagttgaatatttcagcccatgttcaacctatcactcgtacggttttggcttttgcactgactctaacacctgatttccaatgggatgatatggtacatggatatatggaacccttttggattctagttgaggacaataatggcgaatgcattcttcaccacgagtacttcatgcttaagaaacaatacatgaatgaagatcagacacttaactttacagtgccaatatgcaaaccactgccccctcagtactttatacatgtagtatctgacaagtggcttggctctcagacgattcttcctgtctgttttaggcacttgttaccgcactaatgaatgcacgatatgaaggcctttatagtgcctttaaacatttcaaccccattcaaactcaagtgttcaatgtcttgtatagcagtaatgacagtgtgttggttgctgcgccaacaggcagtggaaagaccatatgtgcggagttcgctatactaagaaaccatcagaaggcagtatctggtgaaacgaacatgtgagttgtgtatatagcgcctgttgaagctctggcgaaagaaagatacagggactgggagacaaaattcggagaattcgctcgcgtagttgagctaacaggtgaaactgcgtctgatttgaagcttcttgataaaggggcgattgttataagcactcctgagaattgggacgcgctctcacgccggtggaaacagagaaaacctatccaacaggtcagcttattcattgtcgatgagcttcatctaattggatctgaaaagggacatgttttggaaatcattgtatcaagatgaggcgtattgcaaatcatatttgcagcaatatccgaattgtggcgctttcagcatcacttgcaaatgctaaagatctcggagagtggattggcgccagctcccgtggctttttcaacttccctccagcagtacgaccagtgcctttagaaatacacattcagagtgtggatctagcaaactttgaggcaagaatgcaagcaatggcaaagccaacatacaatgccataagacaacatgcaaaacatggtaagcctgccctggtatttttaccgacacataggcatgcaaggtttactgcgttggatttgtgcgcgtactcaagtgctgaaggttgtgtaacacctttccttcttgggtctcaagatgagattgatactcacacgcaaggtctcagtgaagacacacttaaaaatacactgaaatgtggcgtaggctacttgcatgaggccctaggtgaccttgaccaggaagttgtgactcagttgtttctttgtggaaaaattcaagtgtgtgttgtgagcagcacaatgtgttgggggagatcattgccttcccatttggttgttgtgatgggaacacagtattgtgatgaccgggagagagccaatgctgactattcgatcactgatttgctgcaaatgatcggtcatgccagcaggcctcttaaagacaactcagggaaatttgttatattgtgccatgcacctcgcaaggaatactacaagaagttccttttggaggccttccctgtcgagagccatcttcagcatttcttgcatgaccacatgaatgctgaagttgctgtcggtgtggtagaaaacaagcaaggtgctctggattatcttagttggactttcatgtaccggcgactgaccaagaaccctaactactacaatctgcagggtgtaggtaacaagcatatgtcagatcatctttctgagctaatcgagacagtattggaggaccttgaatcaaccaattgtgtggctatagaggaggatacgtatctgaagcccctcaaccttggtctcattgtctcgtgctactacattagctacatgacaattgaacggttcagtttgatgctaacccagaaaactaagatgaaagatatcctggagattctagcttctgcatcagaatatgcacaacttccaagtcgtggaggtgaggaagaattcatagagaggcttgttcgccaccagacatactctgttgataatcccaagtattgtgatcctcatatcaaggcgaacgcgctgctgcaagcccacttttcaaggcacacggttgtagggaacctggcagttgaccagcgaggagtactcctttatgcacatagattgctccaggcaattgttgatgttgcctccagcaatggttggctcagtctagctcttaatacaattgagctgagtcaaatggtgacacaaggcatgtgggatcgtgattctggctgcttcaactcccacacttcaccaaggagttagcctgtagatgccaggaaaatggcatccagagcatctttaatctggccgggatgggtaccgacgagatcagggatctgctgcagttacctaactctcatctccaggacatcatcggaatcgtcaaacggtaccctgacattgatatggcttatgaagtctgcgaaggtgatgctataagggccaatggcaacgtaattttgcagcttactctagagcgtaacatgacgaacctgacatccgagactgggccagttcatgccccaaggtatccaaagcccagggaggaaggctggtggctcgtgattggtgatagctccgccgaccggctgttggctatcaagagggttgcactccagaagagggctcgactgaagctcgagttcactgctgctgcagaagcagggatgaagaattacatggtttacttgatgtcagattcatatctaggctgtgatcaggagtatgagtttgccgtcaatgtaaaagatactggagggaattgatctgacaatttagtgattgctcaagtaacatctgattctgagtttcttgtaagcagggctattcataggtaatgcgagtcaaaagactcaaaacttgcatcatagatctccgatctttgcaggtcgttgggatgctttttgttgtgatatgatgtggataaacatgagcagatttttttaacatgaatcttgaataacaggcgaacagatatattgtgtttctgtttggat

SEQ ID NO: 3644 - DNA, 1133 bp, Zea mays
aactgtcaaaacggggacacaggccagatggtgcttctgcgcgtttgccgtcacttcggccacctgcgcttcgcctccttcctctcaatggcggcgccccagcaatccgctcccctgtccgggtcggcgcccaagaggctcagggcgatggccacagacgccgctgcagtgccgaatcccccagcctctagtggctgccccgcgatgaaggcggagttcgccaagcacgccgagtacctcaacaccctgaatgacaagagagaaaggcttgtgaaagctagtcgggatattacaatgaacagcaaaaaggtcatctttcaggtccacagaatcacgaaagttaacagggacgaagttctctcgaaggcagaaaatgatcttgctgcagttgttaatcaatacattgcaaaactagtaaaagaattacaaggaactgacttctggaaactcagaagagcctacacctttggtgtacaagaatatgtcgaagctgcaacactctgtagattttgcaagactggcactctattaagccttgctgaaatcaatgattctttactagcactaagtggtcaatctgttgagcccttacagttaaatgtgcttgactatcttttaggggttgctgatttgtccggagagcttatgaggctcgcaataggccgtatatctgatggggaagttgaatatgcaaaaactatctgtgcttttgtgcgggatatttacagggagctgacccttgtggtgcctttaatggatgacaatagtgagatgaagaagaaaatggaggtcatgctgcaaagtgtagtaaaaattgagaatgcttgcttcagtgttcatgtgagaggttcagagtacattcctctgctagaatcatcagcagatccaggctattcttattttggtgccccggactttgatcaatgaatgttttgaagcaagaactaactgagtgttaaaggagcttagatcaatttaaggagagcggttgtgtcaaggctactcttaggtccacagttgggtgtttgattttatcgccagtttatgttgcacatcttgaagtctgtaaatctaagccccaacgtggtaatccgggagaatcatgttgcaatacaacctttttatggtgcaga

SEQ ID NO: 3645 - DNA, 914 bp, Saccharum officinarum
cgcttcccctccttcctctccatggcggcgccccagcaacctggtaaaaccctcctgcgccccagtccttcgcttcccctctccgggtcggcgcccaagaggttcagggcgatggccacagacgtcgcggcggcggcggatcctccagcctccaggggctgtcccgcgatgaaggcggagttcgccaagcacgccgagtacctcaacgccctgaatgacaagagagaaaggcttgtgaaagctagtcgggatgtgacaatgaacagcaaaaaggtcatctttcaggtccatagaatcacgaaagttaacagggacgaagttctctccaaggcagaaaatgatctagctgcagtcgttaatcaatacattgcaaaactagtaaaagaattacaaggaactgacttctggaagctcagaagagcctacacctttggtgtacaagaatatgtcgaagctgcaacactgtgtagattttgcaagactggcactctattaagtctcgctgaaattaatgattctttactagcactaagtgataaatctgttgagcccttacagttaaatgtgcttgactatcttttaggggttgctgatttgtcaggagagcttatgaggctcgcaataggccgtatatctgacggggaagttgaatatgcaaaaactatctgtgcttttgtacgtgatatttacagggagctgactcttgtggtgcctctaatggatgaccataatgagatgaagaagaaaatggaggtcatgctgcaaagcgtagtaaaaattgagaatgcttgcttcagtgttcatgtgagaagttcagagtacattcctctgctaggatcatcagcagacccagattattcctttttcggtgcctcggactttgacaaatgaatgtttggaagcaagaagaacta

SEQ ID NO: 3646 - DNA, 1488 bp, Saccharum officinarum
agaacactcaacacacagagctatcaacattcaacactcaaacagccaacagcgagagagcgagatgaaggttgacgtggtggggacgacgctggtggcgccgagcgaggacacgccgcgccgggagctgtggctgtcgaacctggacctggccgtgcccaagacgcacacgccgctcgtgtactactacccggcgccggcggccgatggagcggccttcttcgcgccggagcggctggaggcggcgctggccagggcgctggtgccgttctacccgctggcggggaggctgggggtgggcgagggcgggcgcctgcagatcgactgcgacgcccagggcgcgctcttcgtcgtcgccagggccgacttcgccggcgacgatgtattcaacgacgactacgagccgtcgccggaggtcaggcggatgttcgtgccgttcgcggcgtccggcgacccgccctgcgtcatggccatgttccaggtgacgttcctcaagtgcggcggcgtggtgctgggcacgggcatccaccacgtgaccatggacggcatgggcgcgttccacttcatccagacctggaccggcgtggcgcggggcctcgacaccgccgaggcgtgcggcccgctaccgccgttccacgaccggacgctcctcggcgcgcgctcccctccgaccccggccttcgaccacccggtctactcgccggccctgctcaacggccacccccgccccttcgtcacccgcatgtacgccgtctccccgaagctcctcgccgacatcaagtcccgctgcgcgccgggcgtgtccacgtactgcgccgtcaccgcgcacctgtggcgctgcatgtgcgtggcgcgcgggctggcgccgggctccgacacgcggctccgcgtccccgccaacgtccgccaccgcctccggccgccgttgccgcggagctacttcggcaacgccatcgtgcgcgacctcgttgtcgcccgggtggaggacgtcctgaagcgcccgctcgggttcgtggcgcaggccatcagggacgcggtggaccgcgtcgacgacgcctacgtgcgctccgtcgtggactacctggaggtggaggcggagaagggcggccaggcggcgcgcgggcagctcatgccggagtccgacctctgggtggtcagctggctcgggatgcccatgtacgacgccgacttcggctggggcacgccgcggttcgtcgcgcccgcgcagatgttcggcagcggcacggcctacgtgacgcagcgcgccaacaaggacgacggcatcgccgtgctctttgggctggagcccgagtacctgcagtgcttcgagaaggtgttctatggggagtgagtcgtgagataaccacactttactagtgccatccgcgtttcatcgtgagcaccgaatgtgattacagtagcttgagcctgatgctctggatgtgtgctgtgtgcatattaaaaaaatcgctccgatttctgtgtcaa

SEQ ID NO: 3647 - DNA, 1743 bp, Zea mays
gtcccggcaccctactataaattgcggtccaacacgcacgctaattgcacacagagctacctactgtaaacattcaacactcaagagccaagagggagagacgatgaaggttgatgtggtggggacgacgcttgtggcgccgagcgaggacacgccgcacccggagctgtggctgtcgaacctggacctggcagtccccaagacgcacacgccgctcgtgtactactacccggcgccggcggccggaggcgacaccgacggagaagcggccttcttcgcgccggagcggctcgaggcggcgctggccaaggcgctggtgccgttctacccgctggcggggaggctgggcgtgggcgagggcgggcgcctgcagatcgactgcaccggcgagggcgcgctcttcgtcgtcgccagggccgacttcgccggcgaggacgtgttcagtgactacgagccgtcgccggaggtcaggcggctgttcgtgccgttcgcggcgtccggagacccgccctgcgtcatgtccatgttccaggtgacgttcctcaagtgcggcggcgtggtgctgggcacgggcatccaccacgtgaccatggacggcatgggcgcgttccacttcatccagacctggaccggcgtggcgcggggcctcgacacggccgaggcgtgcggcccgctgccgttccacgaccggacgctcctccgcgcgcgctctccgccggccccggccttcgaccacccggtctactcgccggctctgctcaacggcgtgccccggcccttcgtcacccgcgtctacgccgtctccccgaagcttctcgctggcatcaagtcccgctgcgcgccgggcgtgtccacctactgcgccgtcaccgcgcacctctggcgttgcatgtgcgtcgcgcgcgggctcgccccgggctcggacacgcggctccgcgtgccggccaacgtccgccaccgcctgcgcccgccgctcccgcggagctacttcggcaacgccatcgtgcgcgacctcgtgaccacccgggtggaggacgtcctggaacgcccgctcgggttcgtggcgcaggcgatcaaggacgcggtggaccgcgtcaatgacgcctacgtgcgctccgtggtcgactacctggaggtggagtcggagaagggcagccaggcggcgcgcgggcagctcatgccggagtccgacctgtgggtggtcagctggctcgggatgcccatgtacgacgccgacttcgggtggggcacgccgcggttcgtcgcgccggcgcagatgttcggcagcggcacggcctacgtcacgcagcgcgccaacagggacgacggcctcgccgtgctcttcgggctggagcccgagtatctgcagtgcttcgaaaaggtgttctatggagagtgagtcgtgagattactagtgtcatccgcgtttcgtcgtgagcaccgagtgcgattactgtagcttggaacctgatgctgtggatgtgggctttgcaaattactccggtttctgtgttttttttcctagtattctcatgtggtttttaggtgctcagtcgagacttgagagagaacatagctgcgttgactttagcatggtttaatttcaactctatgggtctctatctattgtcacattagctatccaccgtactatcgattctattgtcggccgttgtcaaccatatctatagcatggtcgtacaaaatatatgaaaataaaaaacaacatcatcataaataaaa

SEQ ID NO: 3648 - DNA, 1591 bp, Setaria italica
cactcgcagactcgctatcagcagaggctacacgagcagcagagacagcaaagaaagagagagggacgatgaaggttgacgtgatggagacgacgctggtggcgccgagcgaggacacgccacggcgggagctgtggctgtccaacctcgatctcgccgtgcccaagacgcacacgccgctcgtctactactacccggcgtcggaactcggcgccggcgtgggaccggagggctccttctttgcggcggagcggctgaaggcggcgctggccagggcgctggtgccattctacccgctggccggtcggctcggcgtgggtgagggcgggcgcctgcagatcgactgcaacgcggagggcgcgctcttcgtggtcgcccaggccgactttgcgggcgacaatgtcttccgggactacgagccgtcgccggaggtcagacggatgttcgtgccgttcgtgccctccggcgacccgccctgcgtcatggccatgttccaggtgacgttcctcaagtgcggcggcgtggtgctgggcacgggcatccaccacgtggccttggacggcatgggcgcgttccacttcatccagacctggaccggggtgtcccgtggcctcggcaccgccgaggcctgcggcccgccgccgttccacgatcggacgctcctccgcgcgcgctcccctccggcccccgccttccaccaccccgtctactccccggcgctgctcagcggccggccccgtcccttcgtcacccgcgtgtactccgtctccccgaagctcctcgccgacctcaagtcccgctgcgcgcccggcgcgtccacctactgtgccgtcaccgcgcacctctggcgcgccatgtgcgccgcccgcgggctcgccccgggggtcgacacccggctccgcgtgccggccaacgtccgccaccgcctccgcccgccgctgccgcggagctacttcgggaacgccatcgtgcgcgacctcgtcaccgcccgggtggaggacgtgctggcgcgcccgctcgggttcgtggcgcgggcgatcggggacgccgtgggacgcgtggacgacgcctacgcgcgctccgtggtggactacttggaggtggagtccgagaagggcggccaggcggcgcgcgggcagctcatgccggagacggacctgtgggtggtcagctggctggggatgcccatgtacgacgcggacttcggatggagcgcgccgcggttcgtcgcgccggcgcagatgttcggcagcggcacagcgtacgtgacgcagcacgccagcaaggacgacgacggcatcaccgtgcagttcgcgctggagcccgagtacctgcagtgcttcgagaaggtgttctacggggagtgagatcacctttgttgtcttgttaacgtgtgtttgggtttgtaccgactgttctgagtgcttaatatttgaatttggagttcgacgatgtgcatgcataggggcagctttgttggatcaaagctgttttttttatttctcttgtgccgagaatgaatctcatgtgcatttccatgctcatggaagtcaattaactatgagcaaattttacggtcgtaaacttgtcc

SEQ ID NO: 3649 - DNA, 1539 bp, Leymus cinereus x Leymus triticoides
attacacaaacagacactgcacacagtttgttcgagagggacagacacgggagagagatgatgaaggtggaggtggtggagtcgacgctggtggcgccgagcgaggagacgccgcggcgggagctgtggctctccaacctcgacctggccgtgcccaagactcacacgccgctcgtctactactacccggccccggccacagcggcgccggatacggactcggctgacttcttctcgccggagcggctcaaggcggcgctggccagggcgctggtgctcttctacccgctggccgggcggcttgggcgagagggtgagggcggccggctgcagatcgactgcaccggcgagggcgcgctcttcgtcgtcgccagggcgccggacgtcgccggggacgacctcttcgggagcagctacgagccctcgccggaggtcaggcgcatgttcgtgcccttcgcgccctccggcgacccgccgtgcctcatggccatgttccaggtgacgttcctcaagtgcggcggcgtggtgctgggcacgggcatccaccacgtgaccatggacggcatgggcgcgttccacttcatccagacgtggacggggctcgcgcggggcctcgccctctccgaggcgtgcccgtcgccgccgttccacgaccgcacgctactccgcgcgcgctcgccgccacgcccggaattcgaccacccggtgtactcgccggcgtacctaaacggcaccccgcggcccttcgtcacccgcgtctactctgtctccccgaagctcctggcggacctcaagtcccggtgcgggcccggcgtgtccacctacggcgccgtgacggcgcacctatggcgctgcatgtgcgtggcgcgcgggctcgccccgggctcggacacgcgcctccgcgtcccggccaacatccggcaccgcctgcgcccgccgctcccgcgccagttcttcggcaacgccatcgtgcgcgacctcgtcaccgtgaaggtgggcgacgtcctgtcccagccgccggggtacgtggccgacacgatccggaaggcggtggagcacgtcgacgacgcgtacacgcggtcagtgatcgactacctggaggtggagtccgagaagggcagccaggcggcgcgcgggcagctcatgccggagtcggacctgtgggtggtgagctggctggggatgcccatgtacgacgccgacttcgggtggggcgcgccgcggttcgtggcgccggcgcagatgttcggcagcggtacggcgtacgtgacgcagcgcggcgccgacagggacgacggcatcgccgtgctgttcgcgttggagcccgagtacctgcagtgcttccaggacgtcttctacggggagtgacgacatcggtctccctcccctgtgtctctttgtcagtgtgtatcgactatctagcgtttgttgttcagttttggattttgtagaatgcatgtgtacgtagtacttgtcattgtgacctatgtcggccttgcacctgtttcttagggaaaataaacctaatggttgtctaca

SEQ ID NO: 3650 - DNA, 1630 bp, Triticum aestivum
ccacgcgtccgagcaaaagcgagcgcacagacgagattacgcaaagagactctgcacacagtttgtttgagagcgacagacagagcagggagatgatgaaggtggaggtggtggagtcgacgctggtggcgccgagcgaggagacgccacggcgggcgctgtggctctccaacctcgacctggccgtgcccaagacgcacacgccgctcgtctactactacccggccccagccacggcggcgccggacacggactcggccgacttcttctcgccggagcggctcaaggcagcgctggccaaggcgctggtgctcttctacccgctggccgggcgcctcgggcgagagggcgagggcgggcggctgcagatcgactgcaacggcgagggagcgctcttcgtcctcgccagggcgccggacgtcgccggggaggacctcttcgggagcgggtacgagccctcgccggagatcaggcggatgttcgtgcccttcgcgccctccggcgacccgccctgccatatggccatgttccaggtgacgttcctcaagtgcggcggcgtggtgctgggcacgggcatccaccacgtgaccatggacggcatgggcgcgttccacttcatccagacatggacgggtctcgcgcgggggctctccctctccgaggcgtgcccgtcgccgccgttccacgaccgcacgctcctccgcgcgcggtcgccgccgcgcccggaattcgagcacccggtgtactcgccggcgtacctcaacggcgccccacggcccttcgtcacccgcgtctactccgtgtcccagaagctcctcgccgacatcaagtcccggtgcgcgcctggcgtgtccacctacggcgccgtgaccgcgcacctctggcgctgcatgtgcgtggcgcgcgggctcgctccgggctccgacacgcgcctccgcgtgccggccaacatccggcaccgcctgcgcccgcagctcccgcgccagttcttcggcaacgccatcgtgcgcgacctcgtcaccgtcaaggtgggcgacgtgctgtcgcagccgctggggtacgtggccgacacgatccggaaggcggtggaccatgtcgacgacgcgtacacgcggtcggtgatcgactacctggaggtggagtcggagaagggaagccaggcggcgcgcgggcagctcatgccggagtcggacctgtgggtggtgagctggctcgggatgcccatgtacgacgccgactttgggtggggcgcgccgcggttcgtggcgccggcgcagatgttcggcagcggcacggcgtacgtgacgcagcgcggcgccgacagggacgacggcatcgccgtgttgttcgcgctggagcccgagtacctgcagtgcttccaggacgtcttctacggggagtgacaggcaactttctccctcctttgtgtgtgtttgccagtgtgtatgagtgtatccactgtctagcgtttgctgttcagatttggatttggtagaatgcatgtgtacgttgtacgtgccaatgtgtcatatgtcgggcttccaactgttgttagggaaaataaaccataaaatggttgtatacaaacctatctttttttgcgtggatagctggatgtatgtaaccaaaa

SEQ ID NO: 3651 - DNA, 1639 bp, Avena sativa
cccctacgtagtctgtgatagtcagagagatggagatgaaggtggaggtggtggagtcgacgctggtggcgccgagcgaggagacaccgcggctggggctgtggctctccaacctcgacctggccgtgcccaagacgcacacgccgctggtctactactacccggccccgacgccaccggctccgggcggcgcagacagcgaggacttcttctcgcccgaccggctcagggcggcgctggccaaggctctggtgctgttctacccgctggccgggcggctcggcgtggacgagggcgggcggctgcagatcgactgcaacggcgagggcgcgctcttcgtcgtcgcaaaggcggactgcaccggggaggacctcttcgggaaatacgagccctcgccggagatcaggcgtctgttcgtgccgttcacgccctccggggacccgccctgcctaatggccatgtttcaggtaacgttcctcaagtgtggcggagtggtgctgggcacaggaatccaccacgtgactatggacggggctggcgcgttccacttcatccagacgtggacggggctggcgcgtggcctcgccgtctccgaggcgtgcccttcgccgccgtcccacgaccgcacgctcctccgcccgcggtcgccgccacacgccgacttcgaccacccggtctactcccctgcgtacctcaacggagttccgcgctccttcgtgacccgcgtatactccgtctccccgaagctccttgcggacctcaagtctcggtgcgcgcccggcgtgtccacctatggcgccgtcaccgcgcacctctggcgctgcatgtgcgttgcccgcgggctcgcgccggaatccgacacccgcctccgcgtgccggccaacatccgccaccgtctccgcccgtcgctcccgccccagtacttcggcaatgccatcgtacgcgacctcgtcactgtcaaggtgggcgacgtcctggcccagccattggggttcgtggccgaaacgatcaggaaggcggtggaccacgtcgacgacgcgtacgtgcggtcggtgatcgactacctagagctggaatctgagaagggcaatcaagcggcgcgcgggcagctcatgcctgagtctgacctatgggtggtcagctggctgggaatgcccatgtacgacgccgactttggctggggtgcgccacagttcgtcgcgccagcgcagatgttcggcagcggcacggcgtacgtgacgcagcgcgccgacagggatgacggcatagccgtgctgttcgcgctggagcccgagtatctccagtgctttgaggaagtattctacggggagtgatatccgtcggtgcttatcgatcagtttcctgtgtagtatcgactatctcggcgcttgcggttttgttttggattcagtgaatgtttatgtgtcattttgacgtgcgcagcaatgtggtcgatgtacataaaactcgttttagtatgtgcccgcgtagcatccacctcacaaatgtttttatattcgggcagccgtttttctgcagacatgtttggtttctagtcacagttcaccaagagatcttcactcgggttccaatagtccgttcatccgaacgacgaaaaatgggcaagtagcgtttttac

SEQ ID NO: 3652 - DNA, 1677 bp, Avena sativa
caagaacagtccgagcgcacacaaatcacacggacaccccctacgtagtctgtgatagtcagagagatggagatgaaggtggaggtggtggagtcgacgctggtggcgccgagcgaggagacaccgcggctggggctgtggctctccaacctcgacctggccgtgcccaagacgcacacgccgctggtctactactacccggccccgacgccaccggctccgggcggcgcagacagcgaggacttcttctcgcccgaccggctcagggcggcgctggccaaggctctggtgctgttctacccgctggccgggcggctcggcgtggacgagggcgggcggctgcagatcgactgcaacggcgagggcgcgctcttcgtcgtcgcaaaggcggactgcaccggggaggacctcttcgggaaatacgagccctcgccggagatcaggcgtctgttcgtgccgttcacgccctccggggacccgccctgcctaatggccatgtttcaggtaacgttcctcaagtgtggcggagtggtgctgggcacaggaatccaccacgtgactatggacggggctggcgcgttccacttcatccagacgtggacggggctggcgcgtggcctcgccgtctccgaggcgtgcccttcgccgccgtcccacgaccgcacgctcctccgcccgcggtcgccgccacacgccgacttcgaccacccggtctactcccctgcgtacctcaacggagttccgcgctccttcgtgacccgcgtatactccgtctccccgaagctccttgcggacctcaagtctcggtgcgcgcccggcgtgtccacctatggcgccgtcaccgcgcacctctggcgctgcatgtgcgttgcccgcgggctcgcgccggaatccgacacccgcctccgcgtgccggccaacatccgccaccgtctccgcccgtcgctcccgccccagtacttcggcaatgccatcgtacgcgacctcgtcactgtcaaggtgggcgacgtcctggcccagccattggggttcgtggccgaaacgatcaggaaggcggtggaccacgtcgacgacgcgtacgtgcggtcggtgatcgactacctagagctggaatctgagaagggcaatcaagcggcgcgcgggcagctcatgcctgagtctgacctatgggtggtcagctggctgggaatgcccatgtacgacgccgactttggctggggtgcgccacagttcgtcgcgccagcgcagatgttcggcagcggcacggcgtacgtgacgcagcgcgccgacagggatgacggcatagccgtgctgttcgcgctggagcccgagtatctccagtgctttgaggaagtattctacggggagtgatattccgtcggtgcttatcgatcagtttcctgtgtagtatcgactatctcggcgcttgcggttttgttttggattcagtgaatgtttatgtgtcattttgacgtgcgcagcaatgtggtcgatgtacataaaactcgttttagtatgtgcccgcgtagcatccacctcacaaatgtttttatattcgggcagccgtttttctgcagacatgtttggtttctagtcacagttcaccaagagatcttcactcgggttccaatagtccgttcatccgaacgacgaaaaatgggcaagtagcgtttttac

SEQ ID NO: 3653 - DNA, 1689 bp, Zea mays
ctctgctgccaccatccttttgattccacggcctcggtcgactcaccaattcccatacgtattctcgtctgaaacaaaaggaaagagcgaaagaaaaaaaaatcttcccttaatttcagctgatcggcatggcgcagggagcagcaacagccgtagacggcagcggcagcggcagcaccgcccgtccgccggcggcgctgcccggcctgaagctcctccgtcgtctcctcctcgtggcggtggtgggcacgggtttcctggcagtcgtggtactgctctcctcctcatggcgatactcgtcatccatgctccctcgggtccccgcgccggacgtccggctgcccgcgccggcgggcggcgggaaggtgccgctggagcggtgggcgcgggggtccgcgtccgcgtggcacaacctgaccgacgaggagctgctgtgggcggcgtcgtggcggcccggcgtccggcgctacccgtaccgccggacgcccaaggtggccttcatgttcctcacccgcggcccgctgccgctggcgccgctctgggacaggttcttcaccggcgccggggacgcgcgcctcttctccgtgtacgtgcacgccaccccggggtaccgccccggcttcccgccggcgtccgccttctaccgccgcctcgtgcccagccaggtggctcggtggggcgaggcgagcatgtgcgacgcggagcggcggctgctggcgaacgcgctgctggacccggcgaacgagcgcttcgtgctgctctccgagtcgtgcgtgccgctctacggcttcccggcggtgtacagctacctgacgcggtcgcgggagagcttcgtgggcgcgttcgacgacccaggcccgcacggccggggccggtaccgcgccgggctgggccccgaggtgaccgccgggcaattccgcaagggcgcgcagtggttcgagctggaccgcgacctcgccgtcggcgtcgtcgccgacggccgctactaccccaagttccgggaccactgccggccgccgtgctacgtggacgagcactacctgcccacggtgctgtccatcgaggcccccgcgcggatcgccaaccggagcgtcacgtgggtggactggtccccgcgggcggcgcgcaccccggccacgttcggggggaggaggacgtgcacgaggcgttcctcagacgggctcacggcgcccgggaaggaccagggcaactgcacctacaacggccagccggcggaggtgtgcttcctgttcgccaggaagttcgcgcccagcacgctgcgcccgctgctcagcctcgcacccaagttgctcggatacggctgacactgctctgctctgctctcaacctgaaatctgaatcttctccagtgattgataattgattggtataaatatgtactctagactggacgatcgtcatccatcatcgatgtatagatgtagcgaaacatcatttttgggctcaactggtgttaacaccgatagcagcaaagaggagaagagacacgggaaactggacagccggaagaacgaacgaatgttattcagtaaactgttgtcccacaaacgaacggaacacaactatttagactacctctagcaagcttactcattttattttatcttctattttaaattttactatgttaacagcgtagtttactgtataaaattgtgttttgtgttt

SEQ ID NO: 3654 - DNA, 234 bp, Setaria italica
atgtcgccgctggcgccgtcgtcgtcgccggagccggagccgccgttccagccgagggagaagatcttggagaagcagaggtacttccagagcgtccacaagccgacgtacctcaagggccgctacgacgtgatcacctccgtcgccatcccgctcgccctcgccgtctccagcatgtacctcgtcggacgcgggatttacaacatgtcccacggcatcgggaagaaggagtga

SEQ ID NO: 3655 - DNA, 570 bp, Triticum aestivum
tagcatggcgccgtcgtactcgccggagccggagccgccgttccggccgagggaaaagatagtggagaagcagaggtacttccagagcgtgcacaggccgacgtacctcaaggggcgctacgacgtgatcacctccgtcgccatccctctcgccctggccgcctccagcatgttcctcgtcgggcgcgggatctacaacatgtcccacggcatcgggaggaaggagtgaccattgaagccctctcttctgtgacacagacgagcccttgtacagccgtgtgtgtacgtgcctttgtgaagtgaaagcaatgtagtgtgcagtactagaagtgttggattcagatgggagttgtcgccattttgaacgagcaagccaacaatcgagtggttttccagtcaagataacaaaagagcagcatgagcgatgtactggatttgcatgggcgccaaagatcagaaacacatgcagcgcgtaggcaatccatggagaacctatattacattattgttgtgttcgcagattattgtacagtacctttcctcagactgtcatggaagctatatgacccc

SEQ ID NO: 3656 - DNA, 538 bp, Brachypodium distachyon
gcttgcgttgctaactgcagctccttaccagagacaaataaataccagcgttcatcctcgtattctcaactcttggttgcgcatttcgctagcgaggtcacatggcgttgtcgtcggagccggagccgccgttccgtccgagggagaagatcgtggagaagcagaggtacttccagagcgtccacaggccgacgtacctcaaggggcgctacgacgtgatcacctccgtcgccatccccctcgcgctggctgcgtcgagcatgttcctcgttgggcgtgggatctacaacatggctcacggcattgggaggaaagaatgaggattcagagatcggatggcatagcttgtactcatgttgtgtgcgtaccttcgcagaatggaaacgtagacgtgtttgttcccgatgtcgcctgttttaagctgcatcgcttgtacgtaggtacctttgcggaatggaaaccaaaaactaaatgaacttcagtttcaccaaaatttcagcaatttagaaaggggcctaaagccctggacacaatgccc

SEQ ID NO: 3657 - DNA, 2752 bp, Saccharum officinarum
aaaggcacttttacccctgcggctgcgggcatagcgggctcgtccgtccgccgcagtagtagcgaagcactggttgttggtaggtgcacgcaccccaccccccctcctgctgccgtcctcgatctcgtctcctcctcctccccacccaatccctcgcggcgggcgggggaggaagcgagcgacgatggcggcgctggaggcggcgaggtcgtgggcgggctccgtcatcccgccggagctcgccgccgccgcgggcggagacccgctcgccgcgctggcggccaccgccgcggccctcgtcgcggggctgcttatcctcgccgtctggttccgatccggaggcggggcgccgtccaagccggtcgccacgacggtacgcccgccgccggtcaaggtggacgccgacgccgacgtggacgacggccggaagcgcgtcaccatcttcttcggcacgcagaccggcaccgccgagggattcgccaagtccatggcggaggaggcgagggcgcggtacgagaaggccgtgttcaaagtggtggatctggatgactatgctcaggaggacgaggaatacgaggagaagctgaagaaggaaactgtggtgctgttcttcttagcaacatatggggacggagagccaactgataacgcagcaagattctacaaatggtttactgagggaaaagagaaggaagtttggctgaaggatcttaaatatggtatttttggccttggaaacaggcagtatgaacattttaataaggttgcaaaggtggtagatgagctactagaggagcagggtgggaaacgtcttgttcctgttggccttggagatgatgatcagtgcattgaggatgatttcactgcatggaaagaattagtgtggccagagttagatcaattgctccgcgacgaggatgacacaactggtgcatcgactccatatactgctgctattcctgaatacagagttgttttcattgataaatctgacctgtcattccaagatagatcatggacactagccaacggtactggtgtgattgatattcaacacccttgcagggcaaatgttgctgttcggaaggagctgcacaaaccagcttcagatcgctcttgtatccatcttgagttcgacatttctggcactggtcttgtgtatgaaaccggagatcatgttggtgtatatgcagaaaattctgttgagactgtggaggaggctgaaaggctacttgacctttctccagatacattcttctccatccatgcagatgcagaagatggatctcctcgtaaaggaggaggttccttggccccacctttcccatctccatgtaccttgcggactgcgcttctacgatacgctgatctactcaatccaccgaagaaggctgctttgcttgctttagcttctcacgcatctgatccagctgaagctgaacgacttagattcttggcttctcccgctggaaaggatgagtattctcaatggataactgctagtcagaggagccttattgaagttatggctgcattcccttcagctaagccaccactgggagtgttttttgcagcaatatctcctcgtctgcaaccgcgatactactcaatttcatcatctccaaagatggctccctccagaattcatgtaacatgtgcattagtttatgggccttcaccaacaggaaggatccatcaaggagtttgttcaacatggatgaagaatacaattcctctggaatatagcgaagaatgcagctgggctcccatctttgtgaggcagtcaaatttcaaattacctgctgacccgtccactccgattatcatgattggtcctgggacagggctggctccttttagaggcttcttgcaggaaaggttagcactgaaacaatctggagcacaactgggcacttcgatccttttctttggatgcaggaaccgtaacatggactacatatatgaagatgagttgcaaactttccttgaggagggggcgctttctgagctaattgttgcattctctcgggaagggccaacgaaagaatatgtgcagcataagatggtggagaaggccacagaaatttggaacatcatctcacatggtggttacttgtatgtttgcggtgatgccaagggaatggctagagatgtacacagaatgcttcatacaatagtccaagagcagggatctttggatagctccaaaaccgagagctatgtaaagagcctgcagatggaaggcaggtacctccgtgatgtatggtgacacatcacccccaatcagccatagctctagcgtttggaagtaaagctggctttgcgtgtatatgccaacccagtcgtcagctttggaaatgaagcgtgccattgattatatactgaaatgagttgatcagtgtaattctttgacatctaactatttattattatatgagatgggaggaactgagggagaataagtgctgttgtagatttgtagaacttaaaaaatttgtgtatccctgacaagtttgtagccaaggggatacatcatacagtttgagatgaggacattatgtatactgtttgagacgaggacattatgtatactaagtatttaagaaggccactgaaaacaaattttgcatctgtatatttaaagcttgtgcttcttatctaaaaaaactaaaagtactcggacgcgtgggtcgaacgcgtgggtcgggaccggtactgcggccggcctgctaggcgtacagcttaaccacaa

SEQ ID NO: 3658 - DNA, 2700 bp, Zea mays
aagattgagatactaggccttggagggaatttccgtggagaatcaggatcggccccattgccgtctctagcaccactagtagcgaagccactggttgttggtaggtgcacgcaccccaccccctcctgccgtcctcgatctcgtctcctcctccctacccaatccctcgcggtgggcgagggtggaagcgagtgacgatggcggcgctggaggcggcgagggagtgggcgggctccgtcataccgccggagctcgccgccgccgcggggggagacccactcgccgcgctggcggccaccgccgcggccctcgtcgcggggctgcttattatcgctgtctggttccgatccggaggcgggacgccgtccaagccggtcgccacgccggtacggccaccgccggtcaaggtggacgccgacgccgacgttgatgacggccggaagcgcgtcaccatcttcttcggcacacagactggcaccgccgaggggttcgcaaagtccatggcggaggaggcgagggcgcggtacgagaaggccgtgttcaaagtggtggatctggatgactatgctcaggaggacgaggaatacgaggagaagctgaagaaggaaactgtggtgctgttcttcctagcaacatatggggatggggagccaactgataatgcagcacgattctacaaatggtttactgagggaaaagagaaggaagtttggttgaaggatcttaaatatggtatttttggccttggaaacaggcaatacgaacattttaataaggttgcaaaggtggtagatgagctagtagaggagcagggtgggaaacgtcttgttcctgttggccttggagacgatgatcagtgcattgaggatgatttcactgcatggaaagaactagtgtggccagaattagatcaattgctccgcgacgaggatgacacaactggtgcatcgactccatatactgctgctattcctgaatacagagttgttttcattgacaaatctgacctgtcattccaagatagatcatggacactagccaacggtactggtgtgattgatattcaacacccttgcaggtctaatgttgctgttcggaaggagctgcacaaaccagcttcagatcgctcttgtatccatctcgagtttgacatttctggcactggtcttgtgtatgaaaccggagaccatgttggtgtatatgcagaaaattctgttcagactgtggaggaggttgaaaggctacttgacctttctccagacacattcttctccatccatgcagatgcagaagatggatctcctcgtaaaggaggaggttccttggccccacctttcccatctccatgtaccttgcggactgcgcttctacgatatgctgatctactcaatccaccgaagaaggctgctttgcttgctttagcttctcacgcatctgatccagctgaagctgagcgacttagattcttggcttctccttctggaaaggatgagtattctcaatggataactgctagtcagaggagccttcttgaagttatggccgcattcccttcagctaagccaccactgggagtgttttttgcagcaatagctcctcgtctgcaaccacgatactactcaatttcatcatctccaaagatggctccctccagaattcatgtaacatgtgcgttagtttatgggccttcaccaacaggaaggatccaccaaggagtttgttcaacatggatgaagaatacaattcctctggaatatagcgaagaatgcagctgggctcccatctttgtgaggcagtcaaatttcaagttacctgctgatccgtccactcctattatcatgattggtcctgggacagggctggctccttttagaggcttcttgcaggaaaggttagcattgaaacaatctggggcagaattgggcacttcaatccttttctttggatgcaggaaccgtaatatggactacatatatgaagatgagttgcaaactttccttgaggagggggcgctttctgagctaattgttgcattctctcgggaagggccaacgaaagaatatgtgcagcataagatggtggaaaaggccacagatatttggaacatcatctcaaatggtggttacttatatgtttgcggtgatgccaagggaatggctagagatgtacacaaaatgcttcatacaatagtccaagagcagggatctttggataactccaaaaccgagagctatgtaaagagcctgcagatggaaggaaggtacctccgtgatgtatggtgacacatcacctcaaataagccatagctctagcgtgtggaagtaaagctggctttgcgtgtatgacatgtctaatgccaacccaatcgtcagctttggaatgaagcgtgccattgatgatatactgaaatgagttgatcagtgcaattctttgacatctaactatttattattatatgagatgggaggaactgatggagaataaatgctgctgtagatttgtagaagttcaaaaaaattgggtacccctgacaagtttgtagccaagggggtacatcatacagtttgagatgaggacactatgtatactgtttgagacgaggacattatgtatactactctagaaggctaccgaaaccaaattttgcatctgtttattaaaagcttgtacttttatcatggtatccgtcgttggcaatct

SEQ ID NO: 3659 - DNA, 2673 bp, Zea mays
cgcaagagaaaatttcacgttatcttttctttttcgttaaaaaagaagcaagcgaaaaaaaacacttctagccgtgcgggcttggccgtccgcagtagcagcagcaacgaaccaacgaagcactggttgttggtaggtgcacgcaccccatccccccacccaatccctcgcggcgggcgggcgagagagcgagcggcgatggcggcactggaggcggtgaggtcgtgggcggtgtccgtcatcccgccggagctcgccgccgccgcggggggagacccgctcgccgcgctggcagccaccgccgcggcccttgtcgcggggctgcttatcctcgccgtctggttccgatccggaggcggggcgccgtccaagccggtcgccacgccattacggccgccgccggtgaaggtggacgccgacgccgacgtggacgacgggcggaagcgcgtcaccatcttcttcggcacgcagaccggcaccgccgagggattcgccaagtcgatggcggacgaggcgagggtgcggtacgagaaggccgtgtttaaagtggtggatctggatgactatgctcaggaggacgaggaatacgaggagaagctgaagaaggaaactgtggcgctgttcttcttagcaacatatggggatggagagccaactgataacgcagcaagattctacaaatggtttactgagggaaaagagaaggaagtttggctgaaggatcttaaatatggtatttttggccttggaaacaggcagtatgaacattttaataaggttgcaaaggtggtagatgagctactagaggagcagggtgggaaacgtcttgttcctgttggccttggagatgatgatcagtgcattgaggatgatttcactgcatggaaagaactagtgtggccagagttggatcaattgctccgcgacgaggatgacacaaatggtgcatcaactccatatactgctgctattcctgaatacagagttgttttcattgataaatctgacctgtcattccaagatagatcatggtcactagccaacggtactggtgtgattgatattcaccacccttgcagggctaatgttgctgttcgaaaggagctgcacaaaccagcttcagaccgctcttgtattcatcttgagtttgatatttctggcactagtcttgtgtatgaaaccggagaccatgttggtgtatatgcagaaaattctgttgagactgtggaggaggctgaaagcctacttgacctttctccagatacagtcttctccatccatgcagatgcagaagatgggtctcctcgtaaaggaggaagttccttggccccacctttcccatctccatgtactttgcggactgcgcttctacgatatgctgatctactcaatccaccgaagaaggctgctttgcttgctttagcttctcatgcatctgatccagctgaagctgaacgacttaggttcttggcctctcctgctggaaaggatgagtattctcaatggataactgctagtcagaggagtcttcttgaagttatggctgcattcccttcagctaagccaccactgggagtgtttttcgcagcaatagctcctcgtctgcaaccacgatactactcaatttcatcatctccaaagatggctccctccagaattcatgtaacatgtgcattagtttatgggccttcaccaacaggaaggatccaccaaggagtttgttcaacatggatgaagaatacaattcctctggaatatagcgaagaatgcagctgggctcccatatttgtgaggcagtcaaatttcaagttacctgctgacccatccactccgattatcatgattggtcctgggacagggctggctccttttagaggtttcttgcaggaaaggttagcactgaaacaatctggagcagaactgggcacttcaatccttttctttggatgcaggaaccgtaatatggactacatatatgaagatgagctgcaaactttccttgaggagggggcgctttctgagctaattgttgcattctctcgggaagggccaactaaagaatatgtgcagcataagatggtggagaaggccacagaaatttggaacatcatctcacatggtggttacttatatgtatgcggtgatgccaagggaatggctagagacgtacacaggatgcttcatacagtagtccaagagcagggatctttggatagctccaaaaccgagagctacgtaaagagcctgcagatggaaggcaggtacctccgtgatgtatggtgacacatcacccccattcagccatagctctagcgtgtggaagtaaagctggctttgcgtgtacgacatgcctaatgccaaatgaagcgtgccattgattagaaactgaaatgttcagtcgatcagtgtaattctttgacatctaactatttatcattatatggaatgggaggaactgttgtagatttgtagaactacaaaaaaattgtgtatccctaacaagtttgtagcaaagggggtacattattacagtttgagatgaggacatcatgtatactgtttgagacgaggacattatgtatatacttggtacattagaaggccaccgaaaacaaattttgcatctggtttttgaaagcatgtgctcctatcaactatcgtgctgtctgcaat

SEQ ID NO: 3660 - DNA, 2695 bp, Setaria italica
aaaggcacttaagcccctgcctgccgctgcgggcgctctccgtctccagtgggtagtagtaagcgctagttgttggtaggtgcacgcaccccacctcctcccccacccctgccgtcctcgatctcgtctcctcctcctccccacccaaaccctcgcggcgggcgggggaggaagcgggcgagcgatggcggcgctggaggcggcgagggcgtgggcggcgtccgtcatcccgccggagcttgccgccgccgcggggggagacccgctcgccgcgctggcggccaccgccgcggccctcgtcgcggggctgcttatcctcgccgtatggttccgatccgggaacggggcgccggccaagcccgcccccacgccggtacggccgccgccggtgaaaatcgacgccgacgcggacgtggacgacgggcggaagcgcgtcaccatcttcttcggcacgcagaccggcaccgcagagggtttcgccaagtccatggcggaggaggcgagggcgcggtacgagaaggccgtgttcaaagtggtggatctggatgactatgctcaggaggatgaggagtacgaggagaagctcaagaaggaaaccgtagtgctcttcttcttagcaacatatggggacggagagcctactgataatgcagctagattctataaatggttcactgaggggaaagagaaggaagtttggctgaaggatcttaaatttggtgtctttggccttgggaacaggcagtatgaacattttaataaggttgcaaaggtggtggatgagctgctacaggagcagggtgggaaacgtcttgttcctgttggccttggagatgatgatcagtgcattgaggacgacttcaccgcatggaaagaactagtgtggccagagttagaccaattgctccgggatgaggatgacacaactggtgcatcgactccttatactgctgctattcctgaatacagagttgttttcattgatagatctgacctgtcattccaagatagatcttggacactagccaatggtactggtgttattgatattcaccacccttgcaggtctaatgttgctgttcgaaaggagctccataaaccagcttcagatcgctcttgtattcatctggagtttgatatttctggcactggggttgtgtatgaaactggagatcatgtcggtgtatattcggaaaattctgttgagaccgtggaggaagctgaaaagctactcgacctttctccagatacagtcttcactatccatgcagatgcagaagatggatctcctcgtagaggaggaggttccttggccccacctttcccatctccatgtaccttgcggactgcgcttttacgttatgctgatctactcaatccaccaaagaaggctgctttgcttgctttagcttctcacgcttctgatccagctgaagctgaacgacttagattcttggcttctcctgctggaaaggatgagtattctcaatggataactgctagtcagaggagccttcttgaagttatggctgcattcccttcagctaagccaccgctgggagtgtttttcgcagctatagctcctcgtctgcaacctcgatactactcaatatcttcatctccaaagatggctccctccagaattcatgtaacatgcgcattagtttatggtccttcacccacaggaaggatccaccaaggagtttgttcgacatggatgaagaatacaattccgttggaatacagcgaagaatgcagctgggctcctatctttgtgaggcagtcaaatttcaagttaccagctgatccgtccactccaatcatcatgattggtcctgggactgggctggcaccatttagaggcttcttgcaggaaaggttagctctgaaacaatctggagtggaactgggcacttcaattctcttctttggatgcaggaactgtaatgtggactacatatatgaagatgagttgcaaaatttccttcaggaaggggcactttctgagctaattgttgccttttctcgtgaaggaccaacgaaagaatatgtgcagcacaagatggtagagaaggccacagaaatttggaatatcatctcacagggtggttacttgtatgtatgtggtgatgccaagggaatggctagagatgttcatagagtgctgcatactatagtccaagagcagggatctttggatagctccaaaactgagagctacgtaaagagcctgcagatggaaggcaggtaccttcgtgatgtatggtgacacatcacacaaatctgccatagctctagcgcgcgggagtaaagctggcttgcgtgtatgaaatggtgaatgccaacccgattgccagttttcgaaatgaagcgtaccattgattagaatttgtaatgagttgatccgtgtaattctttgacatctaacatggtcctgatatatttattatatggatggtggacactggggagaataagtgctgttgtaggtttgtagaacttgaaattggtatatccccattaagattgtagcaatggggataaatcatacagtttgagatgaggacattatgtatacagtttgagatgaggacattatgtatactacattagaagaccaccgaaaacaaattttgcttctggttttataaagataattgtttactgctattatgattgctgtcgttgcctacct

SEQ ID NO: 3661 - DNA, 2624 bp, Pennisetum glaucum
cggtggtagtggtagtagagcgctagttgttggtaggtgcacgcaccccctacctcctcctcccccccacccctgccgtcctcgatctcgtctcctcctcctcctccctccccacccaaaccctcgcggcgggcgggggaggaagcgggcgagcgatggcggcgctggaggcggcgagggcgtgggcggcgtccgtcatcccgccggagctcgccgccgccgcggggggagacccgctagccgcgctggcggccaccgccgcggccctcgtcgcggggctggttatcctcgccgtgtggttccgatccgggaacgcggcgtcggccaagccggcccccacgcccgtacggccgccgccggtgaaaatcgacgccgacgcggacgccgacgacgggcggaagcgcgtcaccatcttcttcggcacgcagaccggcaccgcggaggggttcgccaagtccatggcggaggaggcgagggcgcggtacgagaaggccgtgttcaaagtggtggatctggatgactatgctcaggaggatgaggagtatgaggagaagctcaagaaggaaactgtagcactcttcttcttggcaacatatggggacggagagcctactgataatgcagcaagattctacaagtggttcacagaggggaaagagaaggaagtttggctgaaggattttaaatatggtgtctttggccttgggaacaggcagtatgagcattttaataaggttgcaaaggtggtggatgagctgctactggagcagggtgggaaacgtcttgttcctgttggccttggagatgatgatcagtgcattgaggacgacttcaacgcatggaaagaactagtgtggccagagttagaccaattgctccgggatgaggatgacacaactggtgcatcaactccttatactgctgctattcctgaatacagagttgttttcatcgataaatctgacctgccattccaagatagatcttggacactagccaatggtactggtgttattgatattcagcacccttgcaggtctaatgttgctgttcgaaaggagctccataaaccagcttcagatcgctcttgtattcatctggagtttgatatttctggcactggggttgtgtatgaaactggagatcatgtcggtgtatattccgaaaattctgttgagactgtggaggaagctgaaaagcttctcgacctttctccagatacattcttctctatccatgcagacgcagaagatggatcccctcgtaaaggaggaggttccttggccccacctttcccatctccatgtaccttgcggactgcacttttacgttatgctgatctactcaatccaccaaagaaggctgctttgcttgctttagcttctcatgcttctgatccagctgaagctgaacgacttagattcttggcttctcctgctggaaaggatgagtattctcaatggataactgctagtcagaggagccttcttgaagttatggctgcattcccttcagctaagccaccactgggagtgtttttcgcagctatagctcctcgtctgcaacctcgctactactcaatatcttcatctccaaagatggctccctccagaattcatgtaacatgcgcattagtttatggtccttcacccacgggaaggatccaccaaggagtttgttcgacatggatgaagaatacatttccgttggaatacagtgaagagtgcagctgggctcctatctttgtcaggcagtcaaatttcaagttacctgctgatccatccactccaattatcatgattggtcctgggactgggctggcaccatttagaggcttcttgcaggaaaggttagctctgaaacaatctggagtggaactgggcacttcaattctcttctttggatgcaggaaccgtaatatggactacatatatgaagatgagttgcaaagtttccttcaggaaggggcactttctgagctgattgttgccttctctcgcgaaggaccaacgaaagaatatgtgcagcataagatggtagagaaggccacagaaatttggaacatcatctcacagggcggttacttatatgtatgtggggatgccaagggaatggcgagagatgtgcatagagtgctgcatactatagtccaggagcagggatcttttgatagctcaaaaactgagagcttcgtgaagagcctgcagatggaaggcaggtatctccgtgatgtatggtgacacatcacacaaatctgccgtagctgtagtgtgtgagagtaaagctggcttgcgcgtatgacatggttaatgccaacccgattgccagttttcaaatgaagcaccattgattagattttggaaggagttaatccgtgtaattctttgacatctaacatggtcctgatatatatttattatatggatggtggaaactggggagaataagtgctgttgtaggttttgtagaacttgaaattgatatgcccccgttaagattgtagcaatggggataaatcatacagtttgagatgaggacattatgtatacagtttgaaatgaggacatcatgtatactacattagaagaccacgaaaacaaaattttgcttctggtttttataaa

SEQ ID NO: 3662 - DNA, 2625 bp, Panicum virgatum
ggtaggtgcacgcaccccacctccctccaccccccttgccgtcctcgatctcggctcctcctcctccccacccaaaccctcgcggcgggcgggggaggaagcgagcgagcgatggcggcgctggaggcggtgagggagtgggcggcgtccgtcatcccgccggagctcgcagctgccgcggggggagacccgctcgccgcgctcgcggccaccgccgcgaccctcgtcgcggggctgcttatcctcgccgtatggttccgatccgggggcggggcgcaggccaagccggcccccacgccgatacgcccggcgccggtgaaggtcgacgccgacgccgacgtggacgacgggcggaagcgcgtcaccatcttcttcggcacgcagaccggcacggccgagggattcgccaagtccatggccgaggaggcgacggcgcggtacgagaaggccgtgttcaaagtggtggatctggatgactatgctcaggaggacgaagagtacgaggagaagctgaagaaggaaaccatagtgctcttcttcttagcaacatatggggacggagagcctacggataatgcagcaagattctacaaatggttcactgaggggaaagagaaggaagtttggctgaaggatcttaaatatggagtctttgggcttgggaaccggcagtacgaacattttaataaggttgcaaatgtggtggatgagctgttacaggagcagggtgggaaacgccttgttcctgttggccttggagatgatgatcagtgcattgaggatgacttcaccgcatggaaagagctagtgtggccagagttggatcagttgctccgcgatgaggatgacaccactggtgcatcgactccttatactgctgctattccagaatacagagttgttttcattgataaatctgacctgtcattccaagatagatcttggtcactagccaatggtactggtgttattgatattcaccacccttgcaggtctaatgttgctgttcgaaaggagctccataaaccagcttcagatcgctcttgtattcatctggagtttgatatatctggcactgggcttgtgtatgaaactggagatcatgtcggcgtgtattcggaaaattctgttgagaccgtggaggaagctgaaaagctacttggactttctccagatacagtcttctctatccacgcagatgcagaagatggatctcctcgtaaaggagggggttccttggccccacctttcccgtctccatgtaccttaaggactgcgcttttacgatacgctgatctactcaatccaccaaagaaggctgctttacttgctttagcttctcatgcttctgatccagctgaagctgaacgacttagattcttggcttctcctgctggaaaggatgagtattctcaatggataactgctagtcagaggagccttcttgaagttatgtctgcgttcccttcagccaagccaccgttgggagtgttttttgcagctatagctcctcgtctgcaaccacgatactactcaatatcatcatccccaaagatggttccctccagaattcatgtaacatgtgcattagtttatggtccttcgccaacaggaaggatccaccaaggagtttgttcgacatggatgaagaatacaattccgttggaatacagcgaggaatgcagctgggctcctatttttgtgaggcagtcaaatttcaagttacctgctgatccatccactccaattatcatgattggccctggaacagggctggcccctttcagaggcttcttgcaggaaaggttagctctgaaacaatctggagtggaactgggcacttcaattctcttctttggatgcaggaaccgtagtatggactacatatacgaagatgagttgcaaaatttccttcaggaaggggcactttctgagctaattgttgccttctctcgtgaagggccaacgaaagaatatgtgcagcataagatggtagagaaggccacagaaatttggaacatcctctcacagggtggttacttgtatgtatgcggcgatgccaagggaatggctagagatgtgcatagaatgctgcatactatagtccaagagcagggatctttggatagctccaaaactgagagctacgtgaagagcctgcagatggagggcaggtacctccgtgacgtatggtgacacgtcacaccaacctgccatagctctagcgtgtggaagtaattaaagctggcttgtgcaaatgacgtggcgaatgccaacccaatcgccagttttcgagatgaagtgtcattgattataatttataatgagtcgatcgttgtaattctttgacatctaacatggtcctgataatatggatggtggaaactggggagaataagcgctgttgtagccttgtaggtttgtagaacttgaaattgttatatccccattaagattgtagcaatggggatacatcatacagtttgagatgaggacattatgtatacagtttgagatgaggatattatgtatactacattagaagacctccgaaaacaaattttgcttctggttttgtaaagatacgctcttacgtcttactgctattatgcttgcagtctttgc

SEQ ID NO: 3663 - DNA, 2608 bp, Brachypodium distachyon
ccacagcagccaagcagttcagcagttggtggtaggtgcgccccacgagcgcctcgcctcggcttgccctccccccatctctgccctccccgggccagtccctccgccggaagggggtagctagctagagaggatggcgctggaggcggcgaggtcgtgggcggcgtccgtgctcccgccggagctcgccgccgccgcggggggcgacccgctcgtcgcgctcgcggccacggccgccgccctcgtggccgggctgctcgtcctggccgtgtggttccgatccggcggcggcgcgccgtccaagccggccgccacgcctctccgcccgccgccggtcaaggtcgacgccgacgccgacgccgacgacggccgcaagcgcgtcaccatcttcttcggcacgcagaccggcaccgccgagggcttcgccaaggctatggccgaggaggccaaggtccggtatgagaagacggtgttcaaagtggtggatctggatgactatgctgcggaggacgacgagtacgaggagaaactgaagaaggaaacactcgtgctgttcttcttagcaacctatggggatggggagcccactgataatgcagcaagattctacaaatggttcaccgaggggaaggagaaggaagtttggctgaaggattttaagtatgctgtatttggtcttgggaacaggcaatatgagcattttaataaggttgcaaaggtggtggacgagctgctggaggagcagggtggcaagcgtcttgttccttgtggccttggtgatgatgatcaatgcattgaggatgacttcaccgcttggaaagaacaagtatggccagaacttgaccaactgcttcgcgatgacgatgatactactggtgcatcaactccgtacactgctgctatacctgaatacagagttgtatttatcgataaatcagatttagtggttgaagataaatcctggactcttgccaatggtaacggcgttattgatatccatcacccttgcaggtctaatgttgctgttcgaaaggaactacataaaccagcttctgaccgctcctgtattcatctggaatttgatatttcaggcactggtcttgtatatgaaactggagatcatgttggtgtgtattcagaaaattccgtcgataccgtggagcaggctgaaaggcttcttggtctttccccagacacagttttctccatacatgcagatgcagaagatggatctcctcgtaaagggggttccttggccccacccttcccatctccgtgcaccttacgaactgcacttttacgttacgctgatctactcaattcaccgaagaaggctgccctggttgctttagcttctcatgcttctgacccgactgaagctgaacgactgagatttttggcctctcctgctggaaaggatgagtattctcagtggatagtagctagccagaggagccttcttgaagtcatggctgcatttccatctgctaagcctcccttgggagtgttctttgcagcagtagctcctcggctacaaccccgatactactccatatcatcgtctccaaagatggctccctccagaattcatgtgacgtgtgcattagtttatggacctacaccaacggaaaggattcaccaaggagtttgctcaacatggatgaagaacacacttccattggaatatagcgaagaatgcagctgggcaccaatttttgtgaggcagtcaaattttaagttacctgcagatccatccactccggttatcatgattggtcctgggactgggctagcaccttttaggggcttcttgcaggaaaggttagctctaaaagaatctggagttggattgggtacttcaatcctcttctttggatgcaggaaccgtaatatggactacatatatgaagatgagttgcaaaatttccttcaggagggggcgctttctgagctagttgtcgcctactctcgtgaaggaccaaccaaagaatatgtgcagcataagatggtggagaaggccacagagatctggaacatcatctctcagggtggttatgtatatgtttgtggtgacgctaagggcatggcgcgagacgtacacagagttcttcacacaatagttcaagagcagggatctttggataactccaaaaccgagagctatgtaaagagcctacagatggaaggcaggtacctccgtgatgtatggtaaataccatctcacattattagctctagcgtgtagaagtaaagatgtgttacctgtatgacatggtggacgccaacccagtcgcgagttttcagaatgaagcgtcccattgcctagaaattggagttaatcggtgtaattctttgacatctaacatggttaccgatatttattatatgtggatggttgaaagaataagagctgttgtagattgatagtactcgaatatccccgagaaatttgtagcaaggggataaatcatacagtttgagacgaggatatcatgtatactttaaatactgccaaaacaaattttgcatctggtttataaaacaagtgcttgtctattatatgatggtgtggggtagctcaaggagcaattcctagtcattttttatc

SEQ ID NO: 3664 - DNA, 2695 bp, Brachypodium distachyon
ggaacttaacccccaacccctttgcgtctccttctccttctcttctccacagcagccaagcagttcagcagttggtggtaggtgcgccccacgagcgcctcgcctcggcttgccctccccccatctctgccctccccgggccagtccctccgccggaagggggtagctagctagagaggatggcgctggaggcggcgaggtcgtgggcggcgtccgtgctcccgccggagctcgccgccgccgcggggggcgacccgctcgtcgcgctcgcggccacggccgccgccctcgtggccgggctgctcgtcctggccgtgtggttccgatccggcggcggcgcgccgtccaagccggccgccacgcctctccgcccgccgccggtcaaggtcgacgccgacgccgacgccgacgacggccgcaagcgcgtcaccatcttcttcggcacgcagaccggcaccgccgagggcttcgccaaggctatggccgaggaggccaaggtccggtatgagaagacggtgttcaaagtggtggatctggatgactatgctgcggaggacgacgagtacgaggagaaactgaagaaggaaacactcgtgctgttcttcttagcaacctatggggatggggagcccactgataatgcagcaagattctacaaatggttcaccgaggggaaggagaaggaagtttggctgaaggattttaagtatgctgtatttggtcttgggaacaggcaatatgagcattttaataaggttgcaaaggtggtggacgagctgctggaggagcagggtggcaagcgtcttgttccttgtggccttggtgatgatgatcaatgcattgaggatgacttcaccgcttggaaagaacaagtatggccagaacttgaccaactgcttcgcgatgacgatgatactactggtgcatcaactccgtacactgctgctatacctgaatacagagttgtatttatcgataaatcagatttagtggttgaagataaatcctggactcttgccaatggtaacggcgttattgatatccatcacccttgcaggtctaatgttgctgttcgaaaggaactacataaaccagcttctgaccgctcctgtattcatctggaatttgatatttcaggcactggtcttgtatatgaaactggagatcatgttggtgtgtattcagaaaattccgtcgataccgtggagcaggctgaaaggcttcttggtctttccccagacacagttttctccatacatgcagatgcagaagatggatctcctcgtaaagggggttccttggccccacccttcccatctccgtgcaccttacgaactgcacttttacgttacgctgatctactcaattcaccgaagaaggctgccctggttgctttagcttctcatgcttctgacccgactgaagctgaacgactgagatttttggcctctcctgctggaaaggatgagtattctcagtggatagtagctagccagaggagccttcttgaagtcatggctgcatttccatctgctaagcctcccttgggagtgttctttgcagcagtagctcctcggctacaaccccgatactactccatatcatcgtctccaaagatggctccctccagaattcatgtgacgtgtgcattagtttatggacctacaccaacggaaaggattcaccaaggagtttgctcaacatggatgaagaacacacttccattggaatatagcgaagaatgcagctgggcaccaatttttgtgaggcagtcaaattttaagttacctgcagatccatccactccggttatcatgattggtcctgggactgggctagcaccttttaggggcttcttgcaggaaaggttagctctaaaagaatctggagttggattgggtacttcaatcctcttctttggatgcaggaaccgtaatatggactacatatatgaagatgagttgcaaaatttccttcaggagggggcgctttctgagctagttgtcgcctactctcgtgaaggaccaaccaaagaatatgtgcagcataagatggtggagaaggccacagagatctggaacatcatctctcagggtggttatgtatatgtttgtggtgacgctaagggcatggcgcgagacgtacacagagttcttcacacaatagttcaagagcagggatctttggataactccaaaaccgagagctatgtaaagagcctacagatggaaggcaggtacctccgtgatgtatggtaaataccatctcacattattagctctagcgtgtagaagtaaagatgtgttacctgtatgacatggtggacgccaacccagtcgcgagttttcagaatgaagcgtcccattgcctagaaattggagttaatcggtgtaattctttgacatctaacatggttaccgatatttattatatgtggatggttgaaagaataagagctgttgtagattgatagtactcgaatatccccgagaaatttgtagcaaggggataaatcatacagtttgagacgaggatatcatgtatactttaaatactgccaaaacaaattttgcatctggtttataaaacaagtgcttgtctattatatgatggtgtggggtagctcaaggagcaattcctagtcattttttatcttgctgtaccgacaatatggcttgcttaaggtaatgtgcaa

SEQ ID NO: 3665 - DNA, 2403 bp, Setaria italica
gggagacccgctcgccgcgctggcggccaccgccgcggccctcgtggctgcttatcctcgccgtatggttccgatccgggaacggggcgccggccaagcccgcccccacgccggtacggccgccgccggtgaaaatcgacgccgacgcggacgtggacgacgggcggaagcgcgtcaccatcttcttcggcacgcagaccggcaccgcagagggtttcgccaagtccatggcggaggaggcgagggcgcggtacgagaaggccgtgttcaaagtggtggatctggatgactatgctcaggaggatgaggagtacgaggagaagctcaagaaggaaaccgtagtgctcttcttcttagcaacatatggggacggagagcctactgataatgcagctagattctataaatggttcactgaggggaaagagaaggaagtttggctgaaggatcttaaatttggtgtctttggccttgggaacaggcagtatgaacattttaataaggttgcaaagggagctgctacaggagcagggtgggaaacgtcttgttcctgttggccttggagatgatgatcagtgcattgaggacgacttcaccgcatggaaagaactagtgtggccagagttagaccaattgctccgggatgaggatgacacaactggtgcatcgactccttatactgctgctattcctgaatacagagttgttttcattgatagatctgacctgtcattccaagatagatcttggacactagccaatggtactggtgttattgatattcaccacccttgcaggtctaatgttgctgttcgaaaggagctccataaaccagcttcagatcgctcttgtattcatctggagtttgatatttctggcactggggttgtgtatgaaactggagatcatgtcggtgtatattcggaaaattctgttgagaccgtggaggaagctgaaaagctactcgacctttctccagatacagtcttcactatccatgcagatgcagaagatggatctcctcgtagaggaggaggttccttggccccacctttcccatctccatgtaccttgcggactgcgcttttacgttatgctgatctactcaatccaccaaagaaggctgctttgcttgctttagcttctcacgcttctgatccagctgaagctgaacgacttagattcttggcttctcctgctggaaaggatgagtattctcaatggataactgctagtcagaggagccttcttgaagttatggctgcattcccttcagctaagccaccgctgggagtgtttttcgcagctatagctcctcgtctgcaacctcgatactactcaatatcttcatctccaaagatggctccctccagaattcatgtaacatgcgcattagtttatggtccttcacccacaggaaggatccaccaaggagtttgttcgacatggatgaagaatacaattccgttggaatacagcgaagaatgcagctgggctcctatctttgtgaggcagtcaaatttcaagttaccagctgatccgtccactccaatcatcatgattggtcctgggactgggctggcaccatttagaggcttcttgcaggaaaggttagctctgaaacaatctggagtggaactgggcacttcaattctcttctttggatgcaggaactgtaatgtggactacatatatgaagatgagttgcaaaatttccttcaggaaggggcactttctgagctaattgttgccttttctcgtgaaggaccaacgaaagaatatgtgcagcacaagatggtagagaaggccacagaaatttggaatatcatctcacagggtggttacttgtatgtatgtggtgatgccaagggaatggctagagatgttcatagagtgctgcatactatagtccaagagcagggatctttggatagctccaaaactgagagctacgtaaagagcctgcagatggaaggcaggtaccttcgtgatgtatggtgacacatcacacaaatctgccatagctctagcgcgcgggagtaaagctggcttgcgtatatgaaatggtgaatgccaacccgattgccagttttcgaaatgaagcgtaccattgattagaatttgtaatgagttgatccgtgtaattctttgacatctaacatggtcctgatatatttattatatggatggtgaacactggggagaataagtgctgttgtaggtttgtagaacttgaaattggtatatccccattaagattgtagcaatggggataaatcatacagtttgagatgaggacattatgtatacagtttgagatgaggacattatgtatactacattagaagaccaccgaaaacaaattttgcttctggttttataaagataattgtttactgctaa

SEQ ID NO: 3666 - DNA, 2783 bp, Oryza sativa
tgctggggcaaaaaaaaaaagtttttaatcaggcgagaaaggcaacaacaagcgcaaagcacgtcaagatcacgccgctcgcctcctccgttgcaaaagacagcgactttataaaaaacagcagaaaaaggcgagacttttagcccccgcaacaactcgtcttcctcccctctccagcagcgtaggccagcgagcggcagcggcagcagcagcagttgttgttgggggtaggtgcgcctcctccccaaccaaaccctcgcttccctcgcgcgcggcgcggcgatggcgctggcgctggaggcggcgaggtcgtgggcggcgtccgtgctgccgccggagctcgccgccgcggcggggggcgacccgctcgccgccctcgccgccacggccgcggcgctcgtcgccggggtggtcatcctcgccgtgtggttccgatccggtggaggggcgccgcccaaggccgccgcgccgccgccgcgcccgccgccggtcaagatcgaggccgacgccgacgccgacgacggccggaagcgcgtcaccgtcttcttcggcacgcagaccggcaccgccgagggcttcgctaaggcgatggcagaggaggcgagggcgcggtacgagaaggcggtgttcaaagttgtggatctggatgactatgcagctgaggatgaggagtacgaggagaagctcaggaaggaaactatcgtgttgctcttcctagcaacatatggggatggggagcctaccgacaatgctgcaagattctacaaatggttcactgaggggaaggaaaaggaagtctggcttaaggatcttaagtatgctgtttttggcctgggaaataggcagtatgagcactttaataaggttgcaaaggtggtggacgaactgctagaggagcagggtggcaagcgtcttgtcccagttggccttggagatgatgatcagtgcattgaggatgacttcacagcatggaaagaacaagtttggccagaattggaccaactgctccgtgatgaagatgatacaactggtgcatccactccttacactgctgctatacctgaatacagaattgtatttattgataaatcagatgtatcgttccaagacaaatcgtggtcacttgccaatggcagtggtgttattgatattcaccatcctgtcaggtctaatgttgctgttcgaaaggaactccataagccagcttcagatcgctcttgcattcatctggagttcgatatctcaggcactggtcttgtgtatgaaactggtgaccatgttggtgtttattcagaaaatgctatcgagacagtggagcaggctgaaaagctgctagatctttccccagatacatttttctccgtccatgcagacgcagaagatggatcacctcgtaaagggggtggttctttggccccacctttcccttctccttgcaccttacggactgcacttctaagatatgctgatctacttaattctccaaagaaggctgctttggttgctttagctgctcatgcgtctgacctagctgaagctgaaagattgagatttttggcttcccctgctggaaaggatgaatattctcaatgggtagtagctagccaaagaagccttcttgaagttatggctgcattcccttcagctaagcccccactgggagtattctttgcagctgttgcacctcgcctacaaccgcgttactactccatatcatcatctccaaagatggctccttccagaattcatgtaacatgtgcgttagtttatggacctacaccaacgggaaggattcaccaaggagtttgttcgacatggatgaagaacgcaatcccatcagaatatagtgaagagtgtagctgggcaccaatttatgtgaggcagtcaaattttaagttgcctgcagatccgaccactccaattatcatgattggtcctggtacagggttagcaccatttagaggcttcttgcaggaaagattagctctaaaacaatctggagttgaactgggcaattcagttctcttctttggatgcaggaaccgtaatatggactacatatatgaagacgagttgcaaaacttcattcaggagggtgcactttctgagctgattgttgccttctctcgtgaaggaccagccaaagaatacgtgcagcataagatgacagagaaggccacagaaatttggaacatcgtctcacaaggtggttacatatatgtgtgcggtgatgccaagggtatggcaagagacgtacacagagctcttcatacaattgttcaagagcagggatctttggatagctccaaaaccgagagctatgtaaagagcctacagatggacggcaggtacctccgtgacgtatggtgacaccatcagaattatcagaaatagctcgctctagctttgtagaagtgaaggtgtcaagagtcggatttgcctgtaaggccatggtgcatgccaatccaatcgtgagtttttcagaacgaagcgtgccgttgcttagaaaattggagttaaaagtcggtgtaattctttgacatctaacatggttccgatatttattattattatatggatgattgaaagaataagtacctgttgtagatttgtagaacctgaaagttggccctgtcccttcagtttgtagtaagagggatacatcatacagtatgagacaatcagattatatcgtgtatacattgaaagaacaccaagccaattttgcatctggtttatgaattaaaacatatgctttaagtagctaccactgttgttttgcc

SEQ ID NO: 3667 - DNA, 2673 bp, Oryza sativa
aaaagacagcgactttataaaaaacagcagaaaaaggcgagacttttagcccccgcaacaactcgtcttcctcccctctccagcagcgtaggccagcgagcggcagcggcagcagcagcagttgttgttgggggtaggtgcgcctcctccccaaccaaaccctcgcttccctcgcgcgcggcgcggcgatggcgctggcgctggaggcggcgaggtcgtgggcggcgtccgtgctgccgccggagctcgccgccgcggcggggggcgacccgctcgccgccctcgccgccacggccgcggcgctcgtcgccggggtggtcatcctcgccgtgtggttccgatccggtggaggggcgccgcccaaggccgccgcgccgccgccgcgcccgccgccggtcaagatcgaggccgacgccgacgccgacgacggccggaagcgcgtcaccgtcttcttcggcacgcagaccggcaccgccgagggcttcgctaaggcgatggcagaggaggcgagggcgcggtacgagaaggcggtgttcaaagttgtggatctggatgactatgcagctgaggatgaggagtacgaggagaagctcaggaaggaaactatcgtgttgctcttcctagcaacatatggggatggggagcctaccgacaatgctgcaagattctacaaatggttcactgaggggaaggaaaaggaagtctggcttaaggatcttaagtatgctgtttttggcctgggaaataggcagtatgagcactttaataaggttgcaaaggtggtggacgaactgctagaggagcagggtggcaagcgtcttgtcccagttggccttggagatgatgatcagtgcattgaggatgacttcacagcatggaaagaacaagtttggccagaattggaccaactgctccgtgatgaagatgatacaactggtgcatccactccttacactgctgctatacctgaatacagaattgtatttattgataaatcagatgtatcgttccaagacaaatcgtggtcacttgccaatggcagtggtgttattgatattcaccatcctgtcaggtctaatgttgctgttcgaaaggaactccataagccagcttcagatcgctcttgcattcatctggagttcgatatctcaggcactggtcttgtgtatgaaactggtgaccatgttggtgtttattcagaaaatgctatcgagacagtggagcaggctgaaaagctgctagatctttccccagatacatttttctccgtccatgcagacgcagaagatggatcacctcgtaaagggggtggttctttggccccacctttcccttctccttgcaccttacggactgcacttctaagatatgctgatctacttaattctccaaagaaggctgctttggttgctttagctgctcatgcgtctgacctagctgaagctgaaagattgagatttttggcttcccctgctggaaaggatgaatattctcaatgggtagtagctagccaaagaagccttcttgaagttatggctgcattcccttcagctaagcccccactgggagtattctttgcagctgttgcacctcgcctacaaccgcgttactactccatatcatcatctccaaagatggctccttccagaattcatgtaacatgtgcgttagtttatggacctacaccaacgggaaggattcaccaaggagtttgttcgacatggatgaagaacgcaatcccatcagaatatagtgaagagtgtagctgggcaccaatttatgtgaggcagtcaaattttaagttgcctgcagatccgaccactccaattatcatgattggtcctggtacagggttagcaccatttagaggcttcttgcaggaaagattagctctaaaacaatctggagttgaactgggcaattcagttctcttctttggatgcaggaaccgtaatatggactacatatatgaagacgagttgcaaaacttcattcaggagggtgcactttctgagctgattgttgccttctctcgtgaaggaccagccaaagaatacgtgcagcataagatgacagagaaggccacagaaatttggaacatcgtctcacaaggtggttacatatatgtgtgcggtgatgccaagggtatggcaagagacgtacacagagctcttcatacaattgttcaagagcagggatctttggatagctccaaaaccgagagctatgtaaagagcctacagatggacggcaggtacctccgtgacgtatggtgacaccatcagaattatcagaaatagctcgctctagctttgtagaagtgaaggtgtcaagagtcggatttgcctgtaaggccatggtgcatgccaatccaatcgtgagtttttcagaacgaagcgtgccgttgcttagaaaattggagttaaaagtcggtgtaattctttgacatctaacatggttccgatatttattattattatatggatgattgaaagaataagtacctgttgtagatttgtagaacctgaaagttggccctgtcccttcagtttgtagtaagagggatacatcatacagtatgagacaatcagattatatcgtgtatacattgaaagaacaccaagccaattttgcatctggtttatgaattaaaacatatgctttaagtagcta

SEQ ID NO: 3668 - DNA, 2542 bp, Triticum aestivum
ggtgcgcctccacgagcgcctcccctcccatcccatccccgtcgcctcctacccccgggcgggccaaggaaggaaggaagagggatggcgctggaggcggcgagggagtgggcggcgtccgtgctgccgccggagctggccgcggcggcggggggcgacccgctggccgcgctcgcggccaccgcggccgcgctcgtcgccgggctgctcgtgctcgccttctggctccgatccggcgggagcgcgccgcccaagccgccccccgcgtccttccgcccgccgcccgtcaaggtcgacgccgacgacgccgacgacggccgcaagcgcgtcaccatcttcttcggcacccagaccggcaccgccgagggcttcgccaaggctatggcggaggaggccaaggcgcggtacgagaaggtcctcttcaaagtggtggatctggatgactatgctgccgaggacgatgagtacgaggagaagctcaagaaggaaacttttgcgctcttcttcttagcaacatatggcgacggggaacccactgataatgcagcaagattctacaaatggttcactgagggtaaggagaaggaggtttggcttaaggatttcaattatgctgtatttggccttggcaacaggcaatacgagcattttaataaggttgcaaaggaggtggatgagttactgctggagcagggtggcaatcgtcttgttccatgtggccttggtgatgatgatcagtgcattgaggatgacttcaccgcatggaaagaactagtatggccagaattggaccaactgctccgtgatgaagatgatactactggtgcaaccactccttacactgctgcaatacctgaatatagagttgtatttattgataaatcagatttagagttcgaagataaatcctggacacttgccaacggcaacggtgttattgatgcccaacacccttgcagggccaatgttgctgttcggaaggaactccataaaccagcctcggatcgctcttgcattcatctggaatttgatatttcaggcactggtcttgtgtatgaaactggggatcatgttggggtttattcagaaaattctatcgagacagtggagcaggctgaaacgctacttgatctttccccagatacagttttctccatacatgcagacgccgaagatggatctcctcgtaaaggcgggggttccttggctccaccattcccatctccttgtaccttacggactgcacttctacgatatgctgatctactcaatgctccaaagaaggctgctttgactgctttagctgctcatgcttctgacccgactgaagctgagcgactgaggttcttggcttctcctgctggaaaggatgagtatgctcaatggatagtagctagccagaggagccttcttgaagttatggctgcattcccttcagctaagccccccttgggggtattctttgcggcgatagctcctcgtctacagccacgattctactccatatcatcatctccaaagttggctccctccagaattcatgtgacatgtgcattagtttatggtcctacaccaacagaaaggatccaccaaggagtttgttcgacatggatgaagaacacacttccattggaatatagcgaagagtgcagttgggcaccaatttttgtgaggcagtcaaattttaggttgcctgcagatccatccactccaatcatcatgattggtcctgggacagggctagcaccttttaggggcttcttgcaggaaagattagctctaaaagaatctggagctgaattgggctcgtcagtcctcttctttggatgcaggaaccgtgaaatggactacatatatgaggaagagttgcaaaatttccttcaggagggggcactctctgagctaattgtcgcctactctcgtgaaggaccaaccaaagaatatgtgcagcataagatggtggacaaggccaccgagatttggaacgtcatttctcaaggtggttacatatatgtttgtggtgatgccaagggcatggcgaaagacgtacacagggttctccacacaatagttcaaaaacagggatctttggataactccaaaactgagctgtatgtaaagaacctacagatggaaggcaggtacctccgtgatgtgtggtaacaacaccctaagacatcggtagccctagcgtgtagaaggaaagaagtaaaaaagatggcgcctgtatggtatggtggatgccaatccgattgtgagttttctgcatccatcccattgcccccgaaattggagttcatcggtgtaattctttgacatctaacatggttctaatatttattgtatggatggttgaaagaataagtgctgttgtagattaatagaacttaaaatgcccctgagaaaattgtagcggggggatgtgaatcatacagtttgagatgagatgggacatatcatgtatacattaaagaccgccaagaacaaattttgcatctggttatagaacaagtgtctagggtaccatcatggtgtttgtggt

SEQ ID NO: 3669 - DNA, 2575 bp, Secale cereale
gaaggaagagggatggcgctggaggcggcgagggagtgggcggcgtccgtgctgccgccggagctggccgcggcggcggggggcgacccgctcgccgcgctcgcggccaccgcggccgccctgctggcggggctgctcgtcctcgccttctggctccgatccggcgggagcgcgccgcccaagccgccccccacgtccttccgcccgccgcccgtcagggtcgacgccgacgacgccgacgacggccgcaagcgcgtcaccatcttcttcggcacccagaccggcaccgccgagggcttcgccaaggctatggcggaggaggccaaggcgcgctacgagaaggtcgtgttcaaagtggtggatctggatgactatgctgccgaggacgacgagtacgaggagaagctcaagaaggaaacgtttgcgctcttcttcttagcaacatatggtgatggggaacccactgataatgcagcaagattctacaaatggttcactgagggtaaggagaaggaggtttggcttaaggattttaattatgctgtatttggccttggcaacaggcaatacgagcattttaataaggttgcaaaggaggtggatgagttactgctggagcagggtggcaagcgtctcgttccatgtggccttggtgatgacgatcagtgcattgaggatgacttcaccgcatggaaagaattagtatggccagaattggaccaactgctccgtgatgaagatgatactactggtgcaaccactccttacactgctgcaatacctgaatacagagttatatttattgataaatcagatttagagttcgaagataaatcctggacacttgccaatggcaacggagttattgatgcccaacacccttgcagggccaatgttgctgtccggaaggaactacataaaccagcctcggatcgctcttgtattcatctggaatttgatatttccggcactggtcttgtgtatgaaactggggatcatgttggggtttattcagaaaattctatcgagacagtggagcaggctgaaacgctacttggtctttccccagatacagttttctccatacatgcagacgccgaagatggatctcctcgtaaaggcgggggttccttggctccaccattcccatctccttgtaccttacggactgcacttctacgatatgctgatctactcaatgttccaaagaaggctgctttgactgctttagctgctcatgcttctgacccgactgaagctgaacgactgaggttcttggcttctcctgctggaaaggatgagtatgctcagtggatagtagctagccagaggagccttcttgaagttatggctgcattcccttcagctaagcctcccttgggggtattctttgcggcgatagctcctcgtctacagccacgattctactccatatcatcatctccaaagttggctcccaacagaattcatgtgacatgtgcattagtttatggtcctacaccaacagaaaggatccaccaaggagtttgttcgacatggatgaagaacacacttccattggaatatagtgaagaatgcagttgggcaccaatttttgtgaggcagtcaaattttaggttgcctgcagatccatccactccaatcatcatgatcggtcctgggacagggctagcaccttttaggggcttcttgcaggaaagattagctctaaaagaatctggggttgaattgggctcttcagtcctcttctttggatgcaggaaccgtgaaatggactacatatacgaggaagagttgcaaaatttccttgaggagggggcactctccgagctaattgtcgcctactctcgtgaaggaccaaccaaagaatatgtgcagcataagatggtggacaaggccaccgagatttggaacgtcatttctcaaggtggttacatatacgtttgtggtgacgccaagggcatggcgaaagacgtacacagggttcttcacacaatagttcaaaaacagggatctttggataactccaaaaccgagctgtatgtaaagaacctacagatggaaggcaggtacctccgtgatgtgtggtaacaacaccctcaggcattgctagccctagcgtgtagaagtaaaaaagatggcgcctgtatggcatggtggatgccaatccgattgtgaattttctgcatcccgttgccacccccgaaattggagttaatcggtgtaattctttgacatctaacatggttctaatatttattgtatggatggttgaaagaataaatgttgttgtagatcagtagaacttaaaatacccctgagaaaattgtagcatggggatggtgaatcatacagtttgagatgagatgaggacatatcatgtatacattaaagaccgccaagaacaaattttgcatctggttatagaacaagtgtctagggtaccatcatggtgtttatggataaggtaaaacttttaaaaaaaaaaaaaaaaaaaaacaaaaaaaaaaaaaataaaaaaaaaaacgtaaaaataagaatacagaccgagacaacgaagacggtagagccacct

SEQ ID NO: 3670 - DNA, 2505 bp, Triticum aestivum
gcgctggaggcggcgagggagtgggcggcgtccgtgctgccgccggagctggccgcggcggcggggggcgacccgctcgccgcgctcgcggccaccgcggccgcgctcgtcgccgggctgctcgtcctcgccttctggctccgatccggcgggagcgcgccgcccaagccggcccccgcgtccttccgcccgccgcccgtcaaggtcgacgccgacgacgccgacgacggccgcaagcgcgtcaccatcttcttcggcacccagaccggcaccgccgagggcttcgccaaggctatggcggaggaggccaaggcgcggtacgagaaggtcgtgttcaaagtggtggatctggatgactatgctgccgaggacgatgagtacgaggagaagctcaagaaggaaacgtttgcgctcttcttcttagcaacatatggcgacggggaacccactgataatgcagcaagattctacaaatggttcactgagggtaaggagaaggaggtttggcttaaggattttaattatgctgtatttggccttggcaacaggcaatacgagcattttaataaggttgcaaaggaggtggatgagttactgctggagcagggtggcaatcgtcttgttccatgtggccttggtgatgacgatcagtgcattgaggatgacttcaccgcatggaaagaactagtatggccagaattggaccaactgctccgtgatgaagatgatactactggtgcaaccactccttacactgctgcaatacctgaatacagagttatatttattgataaatcagatttagagtttgaagataaatcctggacacttgccaatggcaacggtgttattgatgcccaacacccttgcagggccaatgttgctgttcggaaggaactccataaaccagcctcggatcgttcttgtattcatctggaatttgatatttcaggcactggtcttgtgtatgaaactggggatcatgttggggtttattcagaaaattctatcgagacagtggagcaggctgaaacgctacttggtctttccccagatacagttttctccatacatgcagatgccgaagatggatctcctcgtaaaggcgggggttccttggctccaccattcccatctccttgtaccttacggactgcacttctacgatatgctgatctactcaatgctccaaagaaggctgctttgactgctttagctgctcatgcttctgacccgactgaagctgaacgattgaggttcttggcttctcctgctggaaaggatgagtatgctcagtggatagtagctagccagaggagccttcttgaagttatggctgcattcccttcagctaagccgcccttgggggtattctttgcggcgatagctcctcgtctacagccacgattctactccatatcatcatctccaaagttggctccctccagaattcatgtgacatgtgcattagtttatggtcctacaccaacagaaaggatccatcaaggagtttgttcgacatggatgaagaacacacttccactggaatatagcgaagaatgcagttgggcaccaatttttgtgaggcagtcaaattttaggttgcccgcagatccatccactccaatcatcatgattggtcctgggacagggctagcaccttttaggggcttcttgcaggaaagattagctctaaaagaatctggagttgaattgggctcttcagtcctcttctttggatgcaggaaccgtgaaatggactatatatacgaggaagagttgcaaaatttccttcaggagggggcactctccgagctaattgttgcctactctcgtgaaggaccaaccaaagaatatgtgcagcataagatggtggacaaggccatcgagatttggagcgtcatttctcaaggtggttacatatatgtttgtggtgacgccaagggcatggcgaaagacgtacacagggttcttcacacaatagttcaaaaacagggatctttggataactcaaaaactgagctgtatgtaaagaacctacagatggaaggcaggtacctccgtgatgtgtggtaacaacaccctcagacatcggtagccctagcgtgtagaaggagacaagtaaaaaaaatggtgcctgtatggtatggtggatgccaatcccatcgcgagttttctgcatccatcccattgcccccgaaattggagttcattggtgtaattctttgacatctaacatggttctaatatttattgtatggatggatggttgaaagaataagtgttgttgtagattggtagaacttaaaatacccctgagaaagctgtagcaggggggatgatgaatcatacagtttgagatgagatgggacatatcatgtatacattaaagaccgcaagaacaaattttgcatctggttatatagaacaattatatgtggatggtcggacataacgtttggcggtgctgttttaccgagctttcgattgttgtctgttttaaag

SEQ ID NO: 3671 - DNA, 2413 bp, Secale cereale
tggaggcggcgagggagtgggcggcgtccgtgctgccgccggagctggccgcggcggcggggggcgacccgctcgccgcgctcgcggccaccgcggccgccctgctggcggggctgctcgtcctcgccttctggctccgatccggcgggagcgcgccgcccaagccgccccccacgtccttccgcccgccgcccgtcagggtcgacgccgacgacgccgacgacggccgcaagcgcgtcaccatcttcttcggcacccagaccggcaccgccgagggcttcgccaaggctatggcggaggaggccaaggcgcgctacgagaaggtcgtgttcaaagtggtggatctggatgactatgctgccgaggacgacgagtacgaggagaagctcaagaaggaaacgtttgcgctcttcttcttagcaacatatggcgatggggaacccactgataatgcagcaagattctacaaatggttcactgagggtaaggagaaggaggtttggcttaaggattttaattatgctgtatttggccttggcaacagacaatacgagcattttaataaggttgcaaaggaggtggatgagttactcctggagcagggtggcaagcgtctcgttccatgtggccttggtgatgacgatcagtgcattgaggatgacttcaccgcatggaaagaattagtatggccagaattggaccaactgctccgtgatgaagatgatactactggtgcaaccactccttacactgctgcaatacctgaatacagagttatatttattgataaatcagatttagagttcgaagataaatcctggacacttgccaatggcaacggagttattgatgcccaacacccttgcagggccaatgttgctgtccggaaggaactacataaaccagcctcggatcgctcttgtattcatctggaatttgatatttccggcactggtcttgtgtatgaaactggggatcatgttggggtttattcagaaaattctatcgagacagtggagcaggctgaaacgctacttggtctttccccagatacagttttctccatacatgcagatgccgaagatggatctcctcgtaaaggcgggggttccttggctccaccattcccatctccttgtaccttacggactgcacttctacgatatgctgatctactcaatgttccaaagaaggctgctttgactgctttagctgctcatgcttctgacccgactgaagctgaacgactgaggttcttggcttctcctgctggaaaggatgagtatgctcagtggatagtagctagccagaggagccttcttgaagttatggctgcattcccttcagctaaacctcccttgggggtattctttgcggcgatagctcctcgtctacagccacgattctactccatatcatcatctccaaagttggctcccaacagaattcatgtgacatgtgcattagtttatggtcctacaccaacagaaaggatccaccaaggagtttgttcgacatggatgaagaacacacttccattggaatatagcgaagaatgcagttgggcaccaatttttgtgaggcagtcaaattttaggttgcctacagatccatccactccaatcatcatgattggtcctgggacagggctagcaccttttaggggcttcttgcaggaaagattagctctaaaagaatctggggttgaattgggctcttcagtcctcttctttggatgcaggaaccgtgaaatggactacatatacgaggaagagttgcaaaatttccttgaggagggggcactctccgagctagttgtcgcctactctcgtgaaggaccaaccaaagaatatgtgcagcataagatggtggacaaggccaccgagatttggaacgtcatttctcaaggtggttacatatacgtttgtggtgatgccaagggcatggcgaaagatgtacacagggttcttcacacaatagttcaaaaacagggatctttggataactccaaaaccgagctgtatgtaaagaacctacagatggaaggcaggtacctccgtgatgtgtggtaacaacaccctcaggcattgctagccctagcgtgtagaagtaaaaaagatggcgcctgtatggcatggtggatgccaatctgattgtgaattttctgcatcccattgccacccccgaaattggagttaatcggtgtaattctttgacatctaacatggttctaatatttattgtatggatggtcgaaagaataaatgttgttgtagatcagtagaacttaaaatacccctgagaaaattgtagcatggggatggtgaatcatacagtttgagatgagatgaggacatatcatgtatacattaaagaccgccaagaacaaattttgcatctggttatagaacaa

SEQ ID NO: 3672 - DNA, 2343 bp, Avena sativa
tgcggggggcgacccgctagccgcgctcgcggccaccgccgcggcgcttgtcgccggcctgcttatcctagccttctggttccgatccggcgatggcgggtctgccaaggcgcctcccgcgccgctccgcccgccgccggtgaaggtccaggccgaagatgaggacgacggcaggaagcgcgtcaccatcttcttcggcacccagaccggcaccgccgagggcttcgccaaggctatggcggaggaagccaaggcgcggtacgagaaggtggtgttcagagtggtggatctggacgactatgcggcggaggacgaagagtacgaggagaagcttaagaaggaaacgtttgcgctcttcttcctagcaacatatggcgatggggaacctactgataatgcggcaagattctacaaatggttcactgaggggaaggagaaggaaatttggcttaaagattttaaatatgctgtatttgggctcgggaacaggcaatacgagcattttaataaggttgctaaggtggtggatgatctactactggagcagggtggcaagcgtcttgttccttgtggcatgggtgatgatgaccagtgcattgaggatgacttcaccgcctggaaagaattagtatggccagaactggaccaactgctccgtgatgaagatgatactgctggtgcatccactccttacactgctgccatacctgaatacagagttgtatttattgataaatcagatttagtgtttgaagatagatcctggacacttgccaatggcaatggtgttattgatgcccaacacccttgcaggtctaatgttgctgttcggaaggaactccataaaccagcttcagatcgctcttgtattcatctggaatttgacatttcaggcactggtctcatgtatgaaacaggagatcatgttggggtttattcagaaaattctgttgagacagtggagcaggctgaaacactgcttggtctttccccagatacagttttttccatacatgcagacgcagaagatggatctcctcgtaaagggggttccttggctccaccattcccatctccatgtagcctacggactgcactattaaaatatgctgatctactcaattcaccaaagaaggctgctttgactgctttagctgctcatgcttctgacccgactgaagctgaacgactaaggtttttggcttctcctgctggaaaggatgagtatgctcaatggatcgtagctagccagaggagccttattgaagttatggctgcattcccttcagctaagcctcccttgggagtattctttgcagcggtagctcctcgtctgcagccacgattctactccatatcatcatctccgaagatggctccctccagaattcatgtgacatgtgccttagtttatgggcctacaccaacagaaaggatccaccagggggtttgttcgacatggatgaagaacacacttccattggaatatagtgaagaatgcagctgggcaccaatttttgtgaggcaatcaaactttaagttacctgcagacccatccactccaattatcatgattggtcctgggactgggctagcaccttttaggggcttcttgcaggaaagattagctctaaaagaatctggagttgaattgggctcttcagtccttttctttggatgcaggaaccgtgaaatggactacatatatgaagacgagttgcaaaatttcattcaggagggggcgctttccgagctagttatcgcctactctcgtgaaggaccaaccaaagaatatgtgcagcataagatggtggacaaggccacagagatttggaacatcatctctgagggtggttatctgtatgtttgtggtgacgcgaagggcatggcaaaagacgtacatagagttcttcacacaatagttcaaaagcagggatctctggataactccaaaactgagctctatgtaaagaacctacagatggaaggcaggtacctccgtgatgtatggtaacaccaccacacatccgtagccatagcgtgtagaagtgaagatgtgtgtgacatgggaggatgcgaacccgaccttgagttcttcagaacgcagcgtcccattgcctggaagttggacttaatcggtgtaattcttgaacttctaacctttgctccgatatttattatatatatatggatggttgaaataataagtgctgttgtagattattagaccttgaaatatccccgcggaagctgtagcatgggggtacatcatagtttgagatgaggacatcgtgtatacattaaagaactgtgccgaaacaaattttgtatctggtttatata

SEQ ID NO: 3673 - DNA, 2367 bp, Avena sativa
tgcggggggcgacccgctagccgcgctcgcggccaccgccgcggcgcttgtcgccggcctgcttatcctagccttctggttccgatccggcgatggcgggtctgccaaggcgcctcccgcgccgctccgcccgccgccggtgaaggtccaggccgaagatgaggacgacggcaggaagcgcgtcaccatcttcttcggcacccagaccggcaccgccgagggcttcgccaaggctatggcggaggaagccaaggcgcggtacgagaaggtggtgttcagagtggtggatctggacgactatgcggcggaggacgaagagtacgaggagaagcttaagaaggaaacgtttgcgctcttcttcctagcaacatatggcgatggggaacctactgataatgcggcaagattctacaaatggttcactgaggggaaggagaaggaaatttggcttaaagattttaaatatgctgtatttgggctcgggaacaggcaatacgagcattttaataaggttgctaaggtggtggatgatctactactggagcagggtggcaagcgtcttgttccttgtggcatgggtgatgatgaccagtgcattgaggatgacttcaccgcctggaaagaattagtatggccagaactggaccaactgctccgtgatgaagatgatactgctggtgcatccactccttacactgctgccatacctgaatacagagttgtatttattgataaatcagatttagtgtttgaagatagatcctggacacttgccaatggcaatggtgttattgatgcccaacacccttgcaggtctaatgttgctgttcggaaggaactccataaaccagcttcagatcgctcttgtattcatctggaatttgacatttcaggcactggtctcatgtatgaaacaggagatcatgttggggtttattcagaaaattctgttgagacagtggagcaggctgaaacactgcttggtctttccccagatacagttttttccatacatgcagacgcagaagatggatctcctcgtaaagggggttccttggctccaccattcccatctccatgtagcctacggactgcactattaaaatatgctgatctactcaattcaccaaagaaggctgctttgactgctttagctgctcatgcttctgacccgactgaagctgaacgactaaggtttttggcttctcctgctggaaaggatgagtatgctcaatggatcgtagctagccagaggagccttattgaagttatggctgcattcccttcagctaagcctcccttgggagtattctttgcagcggtagctcctcgtctgcagccacgattctactccatatcatcatctccgaagatggctccctccagaattcatgtgacatgtgccttagtttatgggcctacaccaacagaaaggatccaccagggggtttgttcgacatggatgaagaacacacttccattggaatatagtgaagaatgcagctgggcaccaatttttgtgaggcaatcaaactttaagttacctgcagacccatccactccaattatcatgattggtcctgggactgggctagcaccttttaggggcttcttgcaggaaagattagctctaaaagaatctggagttgaattgggctcttcagtccttttctttggatgcaggaaccgtgaaatggactacatatatgaagacgagttgcaaaatttcattcaggagggggcgctttccgagctagttatcgcctactctcgtgaaggaccaaccaaagaatatgtgcagcataagatggtggacaaggccacagagatttggaacatcatctctgagggtggttatctgtatgtttgtggtgacgcgaagggcatggcaaaagacgtacatagagttcttcacacaatagttcaaaagcagggatctctggataactccaaaactgagctctatgtaaagaacctacagatggaaggcaggtacctccgtgatgtatggtaacaccaccacacatccgtagccatagcgtgtagaagtgaagatgtgtgtgacatgggaggatgcaaacccgaccttgagttcccagaacgcagcgtcccattgcctggaagttggacttaatcggtgtaattcttgaacttctaacctttgctccgatatttattatatatatatggatggttgaaataataagtgctgttgtagattattagaccttgaaatatccccgcggaagctgtagcatgggggtacatcatagtttgagatgaggacatcgtgtatacattaaagaactgtgccgaaacaaattttgtatctggtttatatagaacaagtgctttagctgctattat

SEQ ID NO: 3674 - DNA, 2461 bp, Secale cereale
gggatggcgctggaggcggcgagggagtgggcggcgtccgtgctgccgccggagctggccgcggcggcggggggcacccgctcgccgcgctcgcggccaccgcggccgccctgctggcggggctgctcgtcctcgccttctggctccgatccggcgggagcgcgccgcccaagccgccccccacgtccttccgcccgccgcccgtcagggtcgacgccgacgacgccgacgacggccgcaagcgcgtcaccatcttcttcggcacccagaccggcaccgccgagggcttcgccaaggctatggcggaggaggccaaggcgcgctacgagaaggtcgtgttcaaagtggtggatctggatgactatgctgccgaggacgacgagtacgaggagaagctcaagaaggaaacgtttgcgctcttcttcttagcaacatatggcgatggggaacccactgataatgcagcaagattctacaaatggttcactgagggtaaggagaaggaggtttggcttaaggattttaattatgctgtatttggccttggcaacagacaatacgagcattttaataaggttgcaaaggaggtggatgagttactcctggagcagggtggcaagcgtctcgttccatgtggccttggtgatgacgatcagtgcattgaggatgacttcaccgcatggaaagaattagtatggccagaattggaccaactgctccgtgatgaagatgatactactggtgcaaccactccttacactgctgcaatacctgaatacagagttatatttattgataaatcagatttagagttcgaagataaatcctggacacttgccaatggcaacggagttattgatgcccaacacccttgcagggccaatgttgctgtccggaaggaactacataaaccagcctcggatcgctcttgtattcatctggaatttgatatttccggcactggtcttgtgtatgaaactggggatcatgttggggtttattcagaaaattctatcgagacagtggagcaggctgaaacgctacttggtctttccccagatacagttttctccatacatgcagacgccgaagatggatctcctcgtaaaggcgggggttccttggctccaccattcccatctccttgtaccttacggactgcacttctacgatatgctgatctactcaatgttccaaagaaggctgctttgactgctttagctgctcatgcttctgacccgactgaagctgaacgactgaggttcttggcttctcctgctggaaaggatgagtatgctcagtggatagtagctagccagaggagccttcttgaagttatggctgcattcccttcagctaagcctcccttgggggtattctttgcggcgatagctcctcgtctacagccacgattctactccatatcatcatctccaaagttggctcccaacagaattcatgtgacatgtgcattagtttatggtcctacaccaacagaaaggatccaccaaggagtttgttcgacatggatgaagaacacacttccattggaatatagcgaagaatgcagttgggcaccaatttttgtgaggcagtcaaattttaggttgcctgcagatccatccactccaatcatcatgattggtcctgggacagggctagcaccttttaggggcttcttgcaggaaagattagctctaaaagaatctggggttgaattgggctcttcagttctcttctttggatgcaggaaccgtgaaatggactacatatacgaggaagagttgcaaaatttccttcaggagggggcactctccgagctaattgtcgcctactctcgtgaaggaccaaccaaagaatatgtgcagcataagatggtggacaaggccaccgagatttggaacgtcatttctcaaggtggttacatatacgtttgtggtgatgccaagggcatggcgaaagacgtacacagggttcttcacacaatagttcaaaaacagggatctttggataactccaaaaccgagctgtatgtaaagaacctacagatggaaggcaggtacctccgtgatgtgtggtaacaacaccctcaggcattgctagccctagcgtgtagaagtaaaaaagatggcgcctgcatggcatggtggatgccaatccgattgtgaattttctgcatcccattgcctcccccgaaattggagttaatcggtgtaattctttgacatctaacatggttctaatatttattgtatggatggttgaaagaataaatgttgttgtagatcagtagaacttaaaatacccctgagaaaattgtagcatggggatggtgaatcatacagtttgagatgagatgaggacatatcatgtatacattatagaccgccaagaacaaattttgcatctggttatagaacaagtgtctagggtaccatcatggtgtttatgatggctagtc

SEQ ID NO: 3675 - DNA, 2318 bp, Triticum aestivum
gctcctggccgggctgctcgtgctcgccttctggctccgatccggcgggagcgcgccgcccaagccgccccccgcgtccttccgcccgccgcccgtcaaggtcgacgccgacgacgccgacgacggccgcaagcgcgtcaccatcttcttcggcacccagaccggcaccgccgagggcttcgccaaggctatggcggaggaggccaaggcgcggtacgagaaggtcctcttcaaagtggtggatctggatgactatgctgccgaggacgatgagtacgaggagaagctcaagaaggaaacgtttgcgctcttcttcttagcaacatatggcgacggggaacccactgataatgcggcaagattctacaaatggttcactgagggtaaggagaaggaggtttggcttaaggattttaattatgctgtatttggccttggcaacaggcaatacgagcattttaataaggttgcaaaggaggtggatgagttactgctggagcagggtggcaagcgtctcgttccatgtggccttggtgatgacgatcagtgcattgaggatgacttcaccgcatggaaagaactagtatggccagaattggaccaactgctccgtgatgaagatgatactactggtgcaaccactccttacactgctgcaatacctgaatacagagttgtatttattgataaatcagatttagagtttgaagataaatcctggacacttgccaatggcaacggtgttattgatgcccaacacccttgcagggccaatgttgctgttcggaaggaactccataaaccagcctcggatcgctcttgtattcatctggaatttgatatttcaggcactggtcttgtgtatgaaactggggatcatgttggggtttattcagaaaattctatcgagacagtggagcaggctgaaacgctacttggtctttccccagatacacttttctccatacatgcagacgccgaagatggatctcctcgtaaaggcgggggttccttggctccaccattcccatctccttgtaccttacggactgcacttctacgatatgctgatctactcaatgctccaaagaaggctgctttgactgctttagctgctcatgcttctgacccgactgaagctgagcgattgaggttcttggcttctcctgctggaaaggatgagtatgctcagtggatagtagctagccagaggagccttcttgaagttatggctgcattcccttcagctaagccgcccttgggggtattctttgcggcgatagctcctcgtctacagccacgattctactccatatcatcatctccaaagttggctccctccagaattcatgtgacatgtgcattagtttatggtcctacaccaacagaaaggatccatcaaggagtttgttcgacatggatgaagaacacacttccactggaatatagcgaagaatgcagttgggcaccaatttttgtgaggcagtcaaattttaggttgcctgcagatccatccactccaatcatcatgattggtcctgggacagggctagcaccttttaggggcttcttgcaggaaagattagctctaaaagaatctggagttgaattgggctcttcagtcctcttctttggatgcaggaaccgtgaaatggactacatatatgaggaagagttgcaaaatttccttcaggagggggcactctccgagctaattgttgcctactctcgtgaaggaccaaccaaagaatatgtgcagcataagatggtggacaaggccaccgagatttggaacgtcatttctcaaggtggttacatatatgtttgtggtgacgccaagggcatggcgaaagacgtacacagggttcttcacacaatagttcaaaaacagggatctttggataactccaaaactgagctgtatgtaaagaacctacagatggaaggcaggtacctccgtgatgtgtggtaacaacaccctcagacatcggtagccctagcgtgtagaagaagtaaaaaagatggcgcctgtatggtatggtggatgccaatccgatcgtgagttttctgcatccatcccattgcccccgaaattggagttaatcggtgtaattctttgacatctaacatggttctaatatttattgtatggatggttgaaagaaataagtgttgttgtagattagtagaacttaaaatacccctgagaaaattgtagcggggggatgatgaatcatacagtttgagatgagatgggacatatcatgtatacattaaagaccgccaagaacaaattttgcatctggttatatagaaca

SEQ ID NO: 3676 - DNA, 2222 bp, Triticum aestivum
gttccgcccgccgcccgtcaaggtcgacgccgacgacgccgacgacggccgcaagcgcgtcaccatcttcttcggcacccagaccggcaccgccgagggcttcgccaaggctatggcggaggaggccaaggcgcggtacgagaaggtcgtgttcaaagtggtggatctggatgactatgctgcagaggacgatgaatacgaggagaagctcaagaaggaaacgtttgcgctcttcttcttagcaacatatggcgatggggaacccactgataatgcggcaagattttacaaatggttcactgagggtaaggagaaggaggtttggcttaaggattttaattatgctgtatttggccttggcaacaggcaatacgagcattttaataaggttgcaaaggaggtggatgagttactgctggagcagggtggcaagcgtctcgttccatgtggccttggtgatgacgatcagtgcattgaggatgacttcaccgcctggaaagaactagtatggccagaattggaccaactgctccgtgatgaagatgatactactggtgcaaccactccttacactgctgcaatacctgaatacagagttgtatttattgataaatcagatttagagtttgaagataaatcctggacacttgccaatggcaacggtgttattgatgcccaacacccttgcagggccaatgttgctgttcggaaagaactccataaaccagcctcggatcgttcttgtattcatctggaatttgatatttcaggcactggtcttgtgtatgaaactggggatcatgttggggtttattcagaaaattctatcgagacagtggagcaggctgaaacgctacttggtctttccccagatacagttttctccatacatgcagatgccgaagatggatctcctcgtaaaggcgggggttccttggctccaccattcccatctccttgtaccttacggactgcacttctacgatatgctgatctactcaatgttccaaagaaggctgctttgactgctttagctgctcatgcttctgacccgactgaagctgaacgattgaggttcttggcttctcctgctgggaaggatgagtatgctcagtggatagtagctagccagaggagccttcttgaagttatggctgcattcccttcagctaagccgcccttgggggtattctttgcggcgatagctcctcgtctacagccacgattctactccatatcatcatctccaaagttggcgccctccagaattcatgtgacatgtgcattagtttatggtcctacaccaacagaaaggatccatcaaggagtttgttcgacatggatgaagaacacacttccactggaatatagcgaagaatgcagttgggcaccaatttttgtgaggcagtcaaattttaggttgcctgcagatccatccactccaatcatcatgattggtcctgggacagggctagcaccttttaggggcttcttgcaggaaaggttagctctaaaagaatctggagttgaattgggctcttcagtcctcttctttggatgcaggaaccgtgaaatggactacatatatgaggaagagttgcaaaatttccttcaggagggggcactctccgagctaattgtcgcctactctcgtgaaggaccaaccaaagaatatgtgcagcataagatggtggacaaggccaccgagatttggaacgtcatttctcaaggtggttacatatatgtgtgtggtgacgccaagggcatggcgaaagacgtacacagggttctccacacaatagttcaaaaacagggatctttggataactccaaaactgagctgtatgtaaagaacctacagatggaaggcaggtacctccgtgatgtgtggtaacaacaccctcagacatcggtagccctagcgtgtagaaggaaaggaagtaaaaaatatggcgcctgtatggtatggtggatgccaatccaatagcgagttttctgcatccatcccattgcccccgaaattggagttaatcggtgtaattctttgacatctaacatggttctaatatttatcgtatggatggatggttgaaagaaataagtgttgttgtagattagtagaacttaaaatgcccctgagaaaaattgtagcaggggggatgatgaatcatacagtttgagatgagatggacatatcatgtatacattaaagaccgccaaga

SEQ ID NO: 3677 - DNA, 2259 bp, Hordeum vulgare
cggacgagggccgccccccgcgtccttccgcccgccgcccgtaaggtcgacgccgacgacgccgacgacggccgcaagcgcgtcaccatcttcttcggcacccagaccggcaccgccgagggcttcgccaaggctatggcggaggaggccaaggcgcggtacgagaaggccgtcttcaaagtggtggatctggatgactatgctgccgaggacgacgagtacgaggagaagctcaagaaggaaacgtttgcgctattcttcttagcaacatatggcgatggggaacccactgataatgcggcaagattctacaaatggttcactgagggtaaggagaaggaggtttggctgaaggattttaattatgctgtatttggccttggcaacaggcaatacgagcattttaataaggttgcaaaggaggtggatgagttactgctggagcagggtggcaagcgtcttgttccttgtggccttggtgatgacgatcagtgcattgaggatgacttcaccgcatggaaagaactagtatggccagaattggaccaactgctccgtgatgaagatgatactactggtgcaaccactccttacactgctgcaatacctgaatacagagttgtatttattgataaatcagacttagagtttgaagataaatcctggacacttgccaatggcaacggtgttattgatgcccaacacccttgcaggtccaatgttgctgttcggaaggaactccataaaccagcttcggatcgctcttgtattcatctggaatttgatatttcaggcactggtcttgtgtatgaaactggagatcatgttggcgtttattcagaaaattctatcgagacagtggagcaggctgaagcgctacttggtctttccccagacacactattctccatacatgcagatgccgaagatggatctcctcgtaaaggcgggggttccttggctccaccattcccatctccttgtaccttacgaactgcacttctacgatatgctgacttactcaattcgccaaagaaggctgctttgactgctttagctgctcatgcttctgacccagctgaagctgaacgactgaggtttttggcttctcctgctggaaaggatgagtatgctcaatggatagtagctagccagaggagccttcttgaagttatggctgcattcccttcagctaaaccgcccttgggggtattctttgcagcggtagctcctcgtctacagccacgattctactccatatcatcatctccaaagttggctccctctagaattcatgtaacgtgtgcattagtttatgggcctacaccaacagaaaggatccaccaaggagtttgttcgacatggatgaagaacacacttccactggaatatagcgaagaatgcagttgggcaccgatttttgtgaggcagtcaaattttaggttgcctgcagatccatccactcccatcatcatgattggtcctgggactggactagcaccttttaggggctttttgcaggaaagactagctctaaaagaatctggagttgaattgggcagttcagtgctcttctttggatgcaggaaccgcgacatggactatatatacgaggatgagttacaaaatttccttcaggaaggggcactctccgagctaattgtcgcgtactctcgtgaaggaccaaccaaagaatatgtgcagcataagatgattgacaaggccaccgagatttggaacgtcatctctcaaggtggttacatatatgtttgtggtgatgccaagggcatggcgaaggatgtacacagggttcttcacacaatagttcagaagcagggatctttggataactcgaaaaccgagctgtatgtaaagaacctacagatggaaggcaggtacctccgtgatgtgtggtaacaacacccccagacaggcattgctagccctagcgtcgtgtagaagtaaacaagatggcgtctgtatgggcatggtggatgccaatcccaatcgtgagtttcctgcatccatcccattgcccccggaattggagttaatcggtgtaattctttgacatctaacatggttctaatatttattgtatggatggatggttgaaagaataagtgctgttgtagattattagtagaacttaaaatacccctgagaaaattgtagcggggggatgtgaatcatacagtttgagatgagatgaggacatatcatgtatacattaaagaccgcccgccaaaaaacaaattt

SEQ ID NO: 3678 - DNA, 2203 bp, Pennisetum glaucum
gccgtgttcaaagtggtggatctggatgactatgctcaggaggatgaggagtatgaggaaaagctcaagaaggaaactgtagcactcttcttcttggcaacatatggggacggagagcctactgataatgcagcaagattctacaagtggttcacagaggggaaagagaaggaagtttggctgaaggattttaaatatggtgtctttggccttgggaacaggcagtatgagcattttaataaggttgcaaaggtggtggatgagctgctactggagcagggtgggaaacgtcttgttcctgttggccttggagatgatgatcagtgcattgaggacgacttcaacgcatggaaagaactagtgtggccagagttagaccaattgctccgggatgaggatgacacaactggtgcatcaactccttatactgctgctattcctgaatacagagttgttttcatcgataaatctgacctgccattccaagatagatcttggacactagccaatggtactggtgttattgatattcagcacccttgcaggtctaatgttgctgttcgaaaggagctccataaaccagcttcagatcgctcttgtattcatctggagtttgatatttctggcactggggttgtgtatgaaactggagatcatgtcggtgtatattccgaaaattctgttgagactgtggaggaagctgaaaagcttctcgacctttctccagatacattcttctctatccatgcagacgcagaagatggatcccctcgtaaaggaggaggttccttggccccacctttcccatctccatgtaccttgcggactgcacttttacgttatgctgatctactcaatccaccaaagaaggctgctttgcttgctttagcttctcatgcttctgatccagctgaagctgaacgacttagattcttggcttctcctgctggaaaggatgagtattctcaatggataactgctagtcagaggagccttcttgaagttatggctgcattcccttcagctaagccaccactgggagtgtttttcgcagctatagctcctcgtctgcaacctcgctactactcaatatcttcatctccaaagatggctccctccagaattcatgtaacatgcgcattagtttatggtccttcacccacgggaaggatccaccaaggagtttgttcgacatggatgaagaatacatttccgttggaatacagtgaagagtgcagctgggctcctatctttgtcaggcagtcaaatttcaagttacctgctgatccatccactccaattatcatgattggtcctgggactgggctggcaccatttagaggcttcttgcaggaaaggttagctctgaaacaatctggagtggaactgggcacttcaattctcttctttggatgcaggaaccgtaatatggactacatatatgaagatgagttgcaaagtttccttcaggaaggggcactttctgagctgattgttgccttctctcgcgaaggaccaacgaaagaatatgtgcagcataagatggtagagaaggccacagaaatttggaacatcatctcacagggcggttacttatatgtatgtggggatgccaagggaatggcgagagatgtgcatagagtgctgcatactatagtccaggagcagggatcttttgatagctcaaaaactgagagcttcgtgaagagcctgcagatggaaggcaggtatctccgtgatgtatggtgacacatcacacaaatctgccgtagctgtagtgtgtgagagtaaagctggcttgcgcgtatgacatggttaatgccaacccgattgccagttttcaaatgaagcaccattgattagattttggaaggagttaatccgtgtaattctttgacatctaacatggtcctgatatatatttattatatggatggtggaaactggggagaataagtgctgttgtaggttttgtagaacttgaaattgatatgcccccgttaagattgtagcaatggggataaatcatacagtttgagatgaggacattatgtatacagtttgaaatgaggacatcatgtatactacattagaagaccacgaaaacaaaattttgcttctggtttttataaagatcatttcttacagcttgtatgttaaaaaaaaaaaagaaaaaaaaagaaaaaaagtactctgtcgttag

SEQ ID NO: 3679 - DNA, 2388 bp, Solanum tuberosum
acacgcacacgactactacattttcagacatatataatatttatactctttcaatccaaaaccacattattcaaacaacatggcagtcaccacatttttctctctctctctcctcatcatcaccgccgcccttcaagtcgccggacaaacaaccccggtggctgaagctccggcaccggcagccgatgactgtaacggtatattcttgcagtatgtgtttacttccggatctaaaatcaaacccactttgaaagctcgtcaaccctacaagtttcagtctattctcagtataactaacaacgggcttgatgaacttaagttatggagggtttttgttggatttcaacatgatgagattttggtttctgcttctaatgctgtgcttgatgatggggaatcatttcctgctttagttggtaatggtactgtttttgctggatttccagccgccgatcttaagactgctgttgaaacggctggagatactacacagacgactgctcaaatcaaaattgtgggtacccagtttggagttgggtctcctaatgtacctatgccctcgaatatctctttggaaaatgatgggtttatttgccctaaaccttctatgcaaggaaagagtgttatgcaagtatgctgtattaaagacgaaaaattcaagacaaatctgacattgggtgagaaatttagtccacgccaagatggggatcttacaattatgtatgatatcctaagaacatatgattcaaattactgggcacaggttaccatcgcaaaccataacccccttggccgccttgataattggaaactaagttgggactggatgaaggatgagtttatttgggaaatgaagggcgcatatccctctgttgttgatacttctgagtgtgtttttgggccacaggcaaaattttatcaaaaccttgacttttccactggtttgaactgtcagagaaggccgacactaattgatctgccgctggaaaagaccaatgatacaaagttgggaatgataccattttgttgtcggaatgggacaatcttgccacctgctatggacccaagcaagtctgtttcagcattccagatgaatgtctttaaaatgcctccagatctcaatcgctcctcgtttactcctccacagaattggaagatcgaaggcagactgaatccagattataaatgtggacctccagtccgtgtaagccccacccaagtccctgatcctagtggattgttacctgctacatcagtatttgcaagctggcaagttgtatgcaacatcacccagccaaaaggagctagtcccagatgctgtgtttctttctctgctttctacaatgaatcaatcattccttgtccaacatgcgcctgtggttgcccttccaatactgctcgtacatgtagcatgaaagccccagcacttctcctcccatctcaggctcttctggttccatttgacaatagaaccaagatgtcccttgcctgggctgacattaatcatcttccagtttcaaacccattgccatgtggagataactgtggtgtaagcatcaactggcatttgttcacagactataggggcgggtggtctgccaggatcaccatattcaactgggaggacgctgcttttgctgattggttcactgcggtggaattggacaaagcagcagctggttttgatgcagtgtattcattcaacggaactatgttagatggggttaataataccatattcatgcagggccttccaggcttgaactatatagtagcagaagcagatggagctaatccagagaaagatccccgggtacctggaaaacaacaatcagtaatctcattcacaaagaagaatatcccaaacatcaacattgctgctggtgatgggttcccaacaaaattatacttcaatggagaagagtgctcattgccaaaggtactcccaacaagcagttcatctagaatatcttcattcactgtcactacttccattcttgcagcagttgtggtttttatgttggtgcgacaatagcagtgagctgtggtgttttctcttcatttcatacctgccaattgattcattctttagcgtctgctaccaggttttaatgctggtgaccaatctttcaatcagtttgtcagattatgtcaatgtgtattcagggacaaggtttttttcggcaagttttgatttgtaactatttcttactctggaattctcattccagacaatatttgactttaacattaatacctgtataattagcagataagaatacctcagtttgttcatcatcatccttctctctctctctcctagtacaagcgacgtgtgctaacagttccgagtctgtatgcaactcagatgaatcatggtttgtttgt

SEQ ID NO: 3680 - DNA, 2450 bp, Solanum phureja
ccctctccgcgttttcatccttcttctcacatacacatacacacgcacacgactactacattttcagacatatataatatttatactctttcaatccaaaaccacattattcaaacaacatggcagtcaccacatttttctctctctgtctcctcatcatcaccgccgcccttcaagtcgccggacaaacaactccggtggctgaagctccggcaccggcagccgatgactgcaacggtatattcttacagtatgtgtttacttccggatctaaaatcaaacccactttgaaagctcgtcaaccctacaagtttcaatctattctcagtataactaacaacgggcttgatgaacttaagttatggagggtttttgttgggtttcaacatgatgagattttggtttctgcttctaatgctgtgcttgatgatggggaatcatttcctgctttagttggtaatggtactgtttttgctggatttccggctgccgatcttaagactgctattgaaacggctggagatactacacagacgactgctcaaatcaaaattgtgggtactcagtttggagttgggtctcctaatgtacctatgccctcgaatatctctttggaaaatgatgggtttatttgccctaaaccctctatgcaaggaaagagtgttatgcaagtatgctgtattaaagacgaaaaattcaagacaaatctgacattgggtgagaaatttagtccacgccaagatggggatcttacaattatgtatgatatcctaagaacatatgattcaaattactgggcacaggttaccatcgcaaaccataacccccttggccgccttgataattggaaactaagttgggactggatgaaggatgagtttatttgggaaatgaaaggcgcatatccttctgttgttgatacttctgaatgtgtttttgggccacaggcaaaattttatcaaaatcttgacttttccactggtttgaactgtcagagaaggccgacactaattgatctgccgctggaaaagaccaatgatacaaagttgggaatgatacctttttgttgtcggaatgggacaatcttgccacctgctatggacccaagcaagtctgtttcagcattccagatgaatgtctttaaaatgcctccagatctcaatcgctcctcgtttactcctccacagaattggaagattgaaggcagactgaatccagattataaatgtggacctccagtccgtgtaagccccacccaagtccctgatcctagtggattgttacctgctacatcagtatttgcaagctggcaagttgtatgcaacatcacccagccaaaaggagctagccccagatgctgtgtttctttctctgctttctacaatgaatcgatcattccttgtccaacatgcgcctgtggttgcccttccaatactggtcgtacatgtagcacgaaagccccagctcttctcctcccatctcaggctcttctggttccatttgacaatagaaccaagatgtcccttgcctgggctgatattaatcatcttccagtttcaaacccattgccatgtggagataactgtggtgtaagcatcaactggcatttgttcacagactataggggcggatggtctgccaggatcaccatattcaactgggaggacgctgcttttgctgattggttcactgcggtggaattggacaaagcagcggctggttttgatgcagtgtattcattcaacggaactatgttagatggggttaataataccatattcatgcagggccttccaggcttgaactatatagtagcagaagcagatggagctaatccagagaaagatccccgagtacctggaaaacaacaatcagtaatctcattcacaaagaagaatatcccaaacatcaacattgctgctggtgatgggttcccaacaaaattatacttcaatggagaagagtgctcattgccaaaggtactcccaacaagcagttcatctagaatatcttcattcactgtcactacttccattcttgcagcagttgtggtttttatgttggtgcgacaatagcagtgagctgtggcgttttttcttcatttcatacctgccaattgattcattctttagcgtctgctaccaggttttaatgctggtgaccaatctttcaatcagtttgtcagattatgtcaatgtgtatccagggacaagggttttttcggcaagttttgatttgtaactatttcttactctggaattctcattccagacaatatttgactttaacattaatacctgtataattagcagataagaatacctcagtttgttcatcatcatccttctctctctctctcctagtacaagcgacgtgtgctaacagttccgagtctgtatgcaactcagatgaatcatggtttgtttgtctgaaatataaaacttaagtca

SEQ ID NO: 3681 - DNA, 1842 bp, Triticum aestivum
cgggactctcgccgctgcacgcacaccgcagacgcggaggaggagaggcagaaggaggcgacgagcgatggcggccgggacgggcagggtgctgccgctgctggccgtggcggcggcgctcgcggccgcgctcctctacaccgcgcccttctccaagagcctgggcggcgaagggtgcagcctgctcccgcacggccacttctggatcgccagccagcgggtcgtcgcgctcggccgcgtcggccccgccgcagtggaggtgaaggaggggctgatcaacgccatcgccgtgggggactaccggagcttcgtgctccgccgcccgctcgtcgactacggggacgccgtcatcatgcccggcctcatcgacgtgcacgcgcatctcgacgagcctggacgggaggagtgggagggcttctccaccggcacaagagccgccgccgcaggtggcataacaacgttggtggacatgcctctcaacagcttcccttccacggtctctgaagaaactctcaaactcaaggtggatgcagctcgggataagctatatgttgatgtcgggttttggggaggccttgtacccgagaacgccttgaacccaagcaaattggagagcctgctaaatgcaggagtgttaggacttaagtcttttatgtgcccctctggcatcaacgacttccccatgacaaattcaagtcacatcgaggagggcctcgttacattggcaaagtacaaaaggcccttacttatccacgcagaacgcataccggatgtgtcgagtgatgaggagcttgatggcgaattagatcctcgatcatacgcaacatacctgaagtctagaactccagcatgggaggaatcagccgttagggatttgaaacgtgccatgaaggacaccgaggtgggaggccggtcagaaggagctcatcttcacattgtccatctctcagattcaaaaactaccctcgaccttctgaaggatgcaaaacacagcggcgcaaaagtcactatagaaacctgtcctcactacctcgcattttcggccgaggaagttccagatggggacactcgtttcaagtgctctcctcccatacgtgacgccgccaacaaggaagacctctgggaagctctgcttgatggacacattgacatgctcagctcggaccactcaccgtcaactcctgatctcaagctaatggaggaaggcaacttcatgaaggcatggggaggtatctcatctctgcagtttgtgctccctgtaacatggtcacatgggaaaaagtacggcatcactctgaatcagctagcctcgtggtggagcgagaagcccgccgagcttgcggggcagaagaataaggggtctattctgccggggtaccacgctgacatcgttgtgtggaaacccgaggcgcagttccacctcgacgacacccatgccgtataccacaagcaccggaacatctcggcttacctagggaaggagctatcgggcaaggtcctgtcgactttcgtgagggggaacctggttttcgccgaagggaagcacgccggggctgcctgcggcgccaccatcctcgccaagtgaaaccgtagagctacaatatctccgctgatttctagcgtatatgatcgtgtgcgctatgtagtatgttgtataattggatccagtgcatgcatcaattcccctccattgtgtatacccacccattcattggacagcaccagtgtaggttatttctctgaattattaagatgtactagttctgaacttctgagttgtgataatatctatgagaggagtgtgaattattctgctactcttataacttcccgacgaatttt

SEQ ID NO: 3682 - DNA, 1824 bp, Brachypodium distachyon
atggcagcggcggcggcggcggcggggaagggacgggcgctgccgctgctggccgtggcggcggcgctcgcggccgcgctcctctaccgcgcgcccttctccaagagtctgggcggggaagggtgcagcctgctgccgcaggaccacttctggatcgccagcgagcgcgtcgtcacgctcggccgagtcggccccgccgcagtggaagtgaagggagggctgatcaacgcgatcgcggtgggggattaccggagcttcgtgctgcggcggccgctcctcgactacggggatgccgtcatcatgcccggcctcatcgacgtgcacgcgcatcttgacgagcctgggcgcgctgaatgggaggggttctccaccggtacaagagcagctgccgcaggtggcataactacattagtggacatgcccctcaatagcttcccttcaacggtttctgaagaaactctcaaactgaaggtggaagcatctagggacaaactatatgtcgatgtaggtttctggggaggccttgtgccagagaacgccctcaacccaagtaaattggagagtctactcaatgcaggcgttttaggacttaagtcttttatgtgcccatctggtatcaacgactttcccatgacaaattcaactcatattgaggagggcttggttacattggcgaagtacaagaggcctttgcttatccacgcggaacgcataccggatgttgagagtgatgagggcatcgatggtgaactagatcctcgctcttactcaacatatctgaagtctagaccaccaatatgggaggaatcagctatcagagatttgcaacgtgccatgaaggacacaaaggtggggggtcggtcagaaggagctcacattcacattgttcatctctcagatgcagaaacttcccttcagcttcttaaggacgcaaagcacaacggtgcaagagtcagtatagaaacctgtcctcattaccttgcattttcggctgaagaagttccagacggggacactcgtttcaagtgctctcctcctatacgccatgccgctaacaaggacaatctctgggaagctctgcttgatgggcacatagacatgctcagctcagaccattcaccatcaacgcctgatctcaagctaatggaggatggcaacttcttaaaggcatggggaggcatatcatctctgcagttcgttctccctgtgacatggtcatatgggaaaaagcacggcatcaccctgaaccagctcgcttcatggtggagcgagaagcctgctatgctcgctggccaaaagaacaaggggtccattctgcctggataccatgctgacattgtggtttggaaacctgaggcggagttccaactcgacaacagccatgccgtataccacaagcaccggaacatctcggcgtatctagggaaggagctctctgggaaggtcctttcgactttcgtgagagggaacctcgtcttcgcggagggcaagcacgccggggccgcttgtggcgctaccatcctcgccaagtaaaattgtagagctgccatttctgatctgtgtagcgcatatcatcgtgtgcgctgtgtaaatttgtagtatgtagtatctccttgtgtataattgaatcccctgcatccttttcattgttgtacacccatccatttattgggattgccctgcatttcccctcccttggacaggggcagtgtaggatctctagaattattctttgtctgaattgttcagatgaactcctatcttgtacgcgaagctacaatcctaatatcatttctgaaagaataaaagtattcttccacttct

SEQ ID NO: 3683 - DNA, 1920 bp, Brachypodium distachyon
agccggagggagccagtggaggagggcgcacgcagacggggacgggactcggacgccaactcgcactactcgtctcgccgtcagcctgagaggatggcagcggcggcggcggcggcggggaagggacgggcgctgccgctgctggccgtggcggcggcgctcgcggccgcgctcctctaccgcgcgcccttctccaagagtctgggcggggaagggtgcagcctgctgccgcaggaccacttctggatcgccagcgagcgcgtcgtcacgctcggccgagtcggccccgccgcagtggaagtgaagggagggctgatcaacgcgatcgcggtgggggattaccggagcttcgtgctgcggcggccgctcctcgactacggggatgccgtcatcatgcccggcctcatcgacgtgcacgcgcatcttgacgagcctgggcgcgctgaatgggaggggttctccaccggtacaagagcagctgccgcaggtggcataactacattagtggacatgcccctcaatagcttcccttcaacggtttctgaagaaactctcaaactgaaggtggaagcatctagggacaaactatatgtcgatgtaggtttctggggaggccttgtgccagagaacgccctcaacccaagtaaattggagagtctactcaatgcaggcgttttaggacttaagtcttttatgtgcccatctggtatcaacgactttcccatgacaaattcaactcatattgaggagggcttggttacattggcgaagtacaagaggcctttgcttatccacgcggaacgcataccggatgttgagagtgatgagggcatcgatggtgaactagatcctcgctcttactcaacatatctgaagtctagaccaccaatatgggaggaatcagctatcagagatttgcaacgtgccatgaaggacacaaaggtggggggtcggtcagaaggagctcacattcacattgttcatctctcagatgcagaaacttcccttcagcttcttaaggacgcaaagcacaacggtgcaagagtcagtatagaaacctgtcctcattaccttgcattttcggctgaagaagttccagacggggacactcgtttcaagtgctctcctcctatacgccatgccgctaacaaggacaatctctgggaagctctgcttgatgggcacatagacatgctcagctcagaccattcaccatcaacgcctgatctcaagctaatggaggatggcaacttcttaaaggcatggggaggcatatcatctctgcagttcgttctccctgtgacatggtcatatgggaaaaagcacggcatcaccctgaaccagctcgcttcatggtggagcgagaagcctgctatgctcgctggccaaaagaacaaggggtccattctgcctggataccatgctgacattgtggtttggaaacctgaggcggagttccaactcgacaacagccatgccgtataccacaagcaccggaacatctcggcgtatctagggaaggagctctctgggaaggtcctttcgactttcgtgagagggaacctcgtcttcgcggagggcaagcacgccggggccgcttgtggcgctaccatcctcgccaagtaaaattgtagagctgccatttctgatctgtgtagcgcatatcatcgtgtgcgctgtgtaaatttgtagtatgtagtatctccttgtgtataattgaatcccctgcatccttttcattgttgtacacccatccatttattgggattgccctgcatttcccctcccttggacaggggcagtgtaggatctctagaattattctttgtctgaattgttcagatgaactcctatcttgtacgcgaagctacaatcctaatatcatttctgaaagaataaaagtattcttccacttctaat

SEQ ID NO: 3684 - DNA, 1999 bp, Oryza sativa
ggcgcagcccacgcgcacgcgaggaaggaaggaagcagacgcagaaaaggacaggaggtctcgtcacgagcgcgaggaggaggaggaggaggacgacgatggcgatggcggcggcgaagggcagggtcctgccgctgctggcggtggcggcggcgctcgcggcggcgctcctctaccgcgcgcccttttccaagagcctgggcggtgaggggtgcagccttctcccccacgaccacttctggatcgccagcgagcgcgtcgtcacgctcggacgggtcggccccgccgcagtggaggtgaagggagggctgatcaacgcgatcgccgtcggggattaccggagcttcctgctccggcgaccggtggtggactacggtgacgcggttatcatgcccggactgatcgatgtgcacgcgcatcttgatgagccaggacgtgctgagtgggaggggttctccactggtacaagagcagcagctgcaggtggcattacaacattagtggacatgcctcttaatagctacccgtcaactgtttctgaagaaactctcaagctgaagttggatgcagctaaggataaactacatgttgatgtagggttctggggaggcctcgttccagagaatgccctcaatccaagtgcactagagagcctattaaatgcaggcgtcttagggctcaagtcatttatgtgcccctcaggtataaatgacttccccatgacaaattcaactcatattgaggagggcctggttacattggcaaagtacaaaaggccgttacttatccatgcagaacgcatacccgatgttcagaatgaagatgggatcgatggtgaactagatcctaaagcctatacgacatatcttaaatctagaccaccagcatgggaggaagcagcgatcaaagatctgcaacgtgcgatgaaagacacggagatagggggtcggtcagaaggagctcatattcacatagttcatctctcagatgcaaaacttctcttgggcttcttaaggatgcaaaacaaaatggtgcaagggttagtgtagaaacctgtcctcattacctggcgttttcagctgaagaagttcctgatggagatactcgctttaaatgtgctcctcctatacgcgattcaaccaacagagataatctctgggaagctctgcttgatggacacatagacatgttgagctcagaccattcaccatcagctcctgatctcaaactcatggaggaaggtaacttcttaagggcatggggaggcatatcatctttgcagtttgttctccctgtaacatggtcgcatgggaaaaaatacggtatcagtttgaatcaactggcatcatggtggagcgaaaggcctgctatgcttgcagggttaaagaaaaagggtgctgttctgccgggataccgtgctgatattgtggtatggaaacctgaggctcaattccatcttgatgacagccatcctgtctaccataagcatcggaatatttcggcatatttgggaaagcagctttcagggaagatactgtccacctttgtgggtgggaatcttgtgttcgctgaagacaaacatgcaaaggctgcatgtggtgctccaatcctcgccaaataaaattcaggtggatccagtgcttacagttgttgatttgtagtgtatatgatcgtatgcgctacacattttgatttgcggcaaaactgcaaatggcaatgtccctgtgtgtataatttagcccggctcttccattgttatataccactctccattcgattgtgctacattgtacttcatgtggacagcgtatagtgattgtattttttatattattcagatactcctgtaatctagtttacgtggaagtgtaattcagttactttatcagctgtttatgtagatgaactggaataataaacgcgtgatgttagaaatgctttatttgctggttagcctgagctattgctcggttcggctagtcgggtgggcaaacggcat

SEQ ID NO: 3685 - DNA, 1943 bp, Oryza sativa
ggcgcagcccacgcgcacgcgaggaaggaaggaagcagacgcagaaaaggacaggaggtctcgtcacgagcgcgaggaggaggaggaggaggacgacgatggcgatggcggcggcgaagggcagggtcctgccgctgctggcggtggcggcggcgctcgcggcggcgctcctctaccgcgcgcccttttccaagagcctgggcggtgaggggtgcagccttctcccccacgaccacttctggatcgccagcgagcgcgtcgtcacgctcggacgggtcggccccgccgcagtggaggtgaagggagggctgatcaacgcgatcgccgtcggggattaccggagcttcctgctccggcgaccggtggtggactacggtgacgcggttatcatgcccggactgatcgatgtgcacgcgcatcttgatgagccaggacgtgctgagtgggaggggttctccactggtacaagagcagcagctgcaggtggcattacaacattagtggacatgcctcttaatagctacccgtcaactgtttctgaagaaactctcaagctgaagttggatgcagctaaggataaactacatgttgatgtagggttctggggaggcctcgttccagagaatgccctcaatccaagtgcactagagagcctattaaatgcaggcgtcttagggctcaagtcatttatgtgcccctcaggtataaatgacttccccatgacaaattcaactcatattgaggagggcctggttacattggcaaagtacaaaaggccgttacttatccatgcagaacgcatacccgatgttcagaatgaagatgggatcgatggtgaactagatcctaaagcctatacgacatatcttaaatctagaccaccagcatgggaggaagcagcgatcaaagatctgcaacgtgcgatgaaagacacggagatagggggtcggtcagaaggagctcatattcacatagttcatctctcagatgcaaaaacttctcttgggcttcttaaggatgcaaaacaaaatggtgcaagggttagtgtagaaacctgtcctcattacctggcgttttcagctgaagaagttcctgatggagatactcgctttaaatgtgctcctcctatacgcgattcaaccaacagagataatctctgggaagctctgcttgatggacacatagacatgttgagctcagaccattcaccatcagctcctgatctcaaactcatggaggaaggtaacttcttaagggcatggggaggcatatcatctttgcagtttgttctccctgtaacatggtcgcatgggaaaaaatacggtatcagtttgaatcaactggcatcatggtggagcgaaaggcctgctatgcttgcagggttaaagaaaaagggtgctgttctgccgggataccgtgctgatattgtggtatggaaacctgaggctcaattccatcttgatgacagccatcctgtctaccataagcatcggaatatttcggcatatttgggaaagcagctttcagggaagatactgtccacctttgtgggtgggaatcttgtgttcgctgaagacaaacatgcaaaggctgcatgtggtgctccaatcctcgccaaataaaattcaggtggatccagtgcttacagttgttgatttgtagtgtatatgatcgtatgcgctacacattttgatttgcggcaaaactgcaaatggcaatgtccctgtgtgtataatttagcccggctcttccattgttatataccactctccattcgattgtgctacattgtacttcatgtggacagcgtatagtgattgtattttttatattattcagatactcctgtaatctagtttacgtggaagtgtaattcagttactttatcagctgtttatgtagatgaactggaataataaacgcgtgatgttagaaatgcttta

SEQ ID NO: 3686 - DNA, 2141 bp, Secale cereale
gtctctcctcccaatcccatcgcctggcactcccccccgccccgtctcctccccgcacgcatcaccctctccccctcgccgctcggcccgggagaacccacacgcaagcccaacgaacgcgccgcgttgagaaacccacccccgaggaaccacgaccccaggagcgggtccccattgcggcatggctgcggccgccggcgtctggcagctcgttggcgccgccgcggccacgctcctcgcggcggtcctcgtcgccgccgcgctcgggcgccagcgccagcgccgccgccgcagggccccggtcgaagggatccccgcgccggaggacggctgcgcggtcgccgacggcgcagggagcgcggccgtggacggcccgacggacgtcatcatcgtcggagccggggtcgccggatctgccctcgcctacacgctcggaaaggatggtcgacgggtccatgttatagagagagacctgacagagcccgatagaattgtgggtgaattgttacaacctggaggctacctgaaattgatggaattgggtctgcaggactgcgttgatgaaattgatgcacagcgtgttcttggttatgcattattcaaagatgggaagaacacaaaactttcttaccccttggagaagttccattcagatgtggctggcaggagctttcacaatggacggttcatacagaggatgcgtgaaaaggctgcatctttgcccaatgtccaactggagcaaggaacagttacatctttgcttgaagaaaatggtacagttaagggtgtgcaatacaaggtcaagtcaggtgaagaacaaaaagcttatgcaccattgacaattgtatgtgatggctgcttttcgaacttaagacgcgccctttgctctccaaaggttgaggtgccgtcttgctttgttggcctggtcctggagaattgtgaacttcctcatgcgaaccatggccatgttatcttggccaatccttctcccatcctattttacccgataagcagcaccgaggttcgctgtttggtagatgtccctggtcagaaggtgccttccatagcaagtggtgaaatggcaaattatctcaagaccgtggttgcacctcagattcctccacaaatctatgattcttttatagcagcaattgataagggaagcataagaacaatgccaaataggagcatgccagctgcaccacatccaacacctggtgcacttttgatgggagatgctttcaatatgcgacaccctttaacaggtggaggaatgactgttgcattatcagatatagtcgtcctgcgtaatcttctcaagcctcttcgcaatctgcatgatgcctctgctctctgcaaatacctagagtcattctatactctgcggaagccggttgcttctacaataaacacattggctggtgctctatacaaagtcttcagttcctcgcctgacaaggctagggacgagatgcgccaagcttgctttgattacttaagccttgggggtgtctgttcaaatgggcccattgctctactctctggtcttaatcctcggccattgagtttggttgcacacttctttgctgttgctatctttggtgttggacggctgatgctccccctcccttcacctaaacgaatgtggaccggagcgagattgatttcgggcgcatgtggtatcatcttcccgatcatcaaagctgaaggtgtgaggcaaatgttcttccctgctaccgtccccgcgtattaccgtgctcctcctgaagcggagttctgaagtatgaaggtgcagctaatctctctcgcacgatgacatttttcctgtgttggtagtcgttcgccagtgttagttgcagtgtgctgtgttggtagtctgaatggatctatgaacgtgtatagtatctcctgtgggtgctgatcctgtttgttgaaatgctctgaattgctgcatcggtgcccatgttgattcgtcctagctaaattgtacatctttgttgtactactgatgaaccgcgcctgctgatccaactagtggactaggtggtgttccttgtctactactgaacgtgtacgtttcaaatcgaccaattgataccatgttaagcagaaccctgttatggaccatgaatccatgatat

SEQ ID NO: 3687 - DNA, 2151 bp, Secale cereale
ataaaaacggaacaatctccaactcgaagcggccgcctctcgtctggtctcgtctctcgtcccaatccctccgcctggtactccccccgctccgtctcctccccgcacgcatcaccctctccccctcgccgctcggcccgggagaacccacacgcaagcccaacgaacgcgccgcgttgagaaacccacccccgaggaaccacgaccccaggagcaggtccccattgcggcatggctgcggccgccggcgtctggcagctcgttggcgccgccgcggccacgctcctcgcggcggccctcgtcgccgtcgcgctggggcgccagcgccagcgccgccgccgcagggccccggtcgaagggatccccgcgccggtggacggctgcgcggtcgccgacggcgcagggagcgcggccgtggacggcccaacggacgtcatcatcgtcggagccggggtcgccggatctgccctcgcctacacgctcggaaaggatggtcgacgggtccatgttatagagagagacctgacagagcccgatagaattgtgggtgaattgttacaacctggaggctacctgaaattgatggaattgggtctgcaggactgcgttgatgaaattgatgcacagcgtgttcttggttatgcattattcaaagatgggaagaacacaaaactttcttaccccttggagaagttccattcagatgtggctggcaggagctttcacaatggacggttcatacagaggatgcgtgaaaaggctgcatctttgcccaatgtccaactggagcaaggaacagttacatctttgcttgaagaaaatggtacagttaagggtgtgcaatacaagatcaagtcaggtgaagaactaaaagcttatgcaccattgacaattgtatgtgatggctgcttttcgaacttacgacgtgccctttgctctccaaaggttgaggtgccgtcttgctttgttggcctggtcctggagaattgtgaacttcctcatgcgaaccatggccatgttatcttggccaatccttctcccatcctattttacccgataagcagcaccgaggttcgctgtttggtagatgtccctggtcagaaggtgccttccatagcaagtggtgaaatggcaaattatctcaagaccgtggttgcacctcagattcctccacaaatctatgattcttttatagcagcaattgataagggaagcataagaacaatgccaaataggagcatgccagctgcaccacatccaacacctggtgcacttttgatgggagatgctttcaatatgcgacaccctttaacaggtggaggaatgactgttgcattatcagatatagtcgtcctgcgtaatcttctcaagcctcttcgcaatctgcatgatgcctctgccctctgcaaatacctagagtcattctatactctgcggaagccggttgcttctacaataaacacattggctggtgctctatacaaagtcttcagttcctcgcctgacaaggctagggatgagatgcgccaagcctgctttgattacttaagccttggaggtgtctgttcaaatgggcccattgctctactctctggtcttaatcctcggccattgagtttggttgcacacttctttgctgttgctatctttggtgttggacggctgatgctcccccttccttctcctaaacgtatgtggaccggagcgagattgatttcgggcgcatgtggtatcatcttcccgatcatcaaagctgaaggcgtgaggcaaatgttcttccctgctaccgtccccgcgtattaccgtgctcctcctgaagcggagttctgatgtatgaaggtgcagctaatctctctcgcatgatgacatttttcctgtgttggtagtcgttcgccagtgttagtcacaatgtgctgtgttggtagttcgaatggatcgatgaacgtgtatagtatctcctgtgggtgctgatcctgtttgttgaaatgctctgaattgctgcatcggtgcccatgttgattcgttctagctaaattgtaagtacatctttgttgtactactgatgaaccgcgcctgccgatccaactagtggactaggtggcgttccttgtctactgaacgtgtacgtttcaaatcgaccaatgtatacca

SEQ ID NO: 3688 - DNA, 2130 bp, Avena sativa
cggagagagagcggccatctaccccataaaaagagaccccagaatctccaactccaagcggtcgcctcgtctcgtcccaatcccctgttccgtttcgtcccgctccctccctcccgcacgcatcagcctcctcctcgaccccatcctcgcctcgcctcgcctcgcccaacacagcccacacgtctccaaacggaaacagacgccaccaccgccccgcgctgcgtcgagaaaacccctctgcccgaggaagttcttcctcattgcggcatggctgaggtcgccgccgtcgggcagctcggtggcgccgccaccgcggccacgctcctcgcggcgctcttcctcgccgtcctgtttcggcaccagagacggcggcggcagcgcggcgctccggtggaagggatccccgcgccggtggaccgctgcgcggtcgctgacggcgaagggattgccgccctggatggcccgacggacgtcatcatcgttggagccggggtggccggatctgcgctcgcctacacgctcggaaaggatggtcgccgggtgcatgttatagagagagacttgactgagccagatagaattgtcggtgaactattacaacctggaggctacctgaaattggttgaactgggtctccaggattgtgttgatgaaattgacgcacagcgtgttcttggttatgcattattcaaagatggaaagaacaccaagctttcttatcccttggaaaagttccattcagatgttgctggtaggagctttcacaatggacggtttatacagaggatgcgtgaaaaagctgcgtctttgcctaatgtccagttggagcaaggaacagttacttctttgcttgaagaaaatggtacagttaagggtgtacaatacaagaacaagtcaggtgaagaactaaaagctcatgcaccattgacaattgtatgtgatggttgcttttcaaatttacgacgtgcactttgttctccaaaggttgagtcgccatcttgttttgttggactggtcttggagaattgtgaacttcctcaccgaaatcacggccatgttatcttggccaatccttcaccgatcctattttacccaataagcagcactgaggttcgctgtttagttgatgtccctggtcagaaggtgccttccattgcaagtggtgaaatggcaaattatctcaagaccgtggttgcacctcagatccctccagaaatctatgattcctttgtagcagccattgacaagggaagcataagaacaatgccaaataggagcatggcagctgccccacatccaacacctggtgcacttttgatgggagatgctttcaatatgcgacaccctttaactggtggaggaatgacagttgcgttatctgatatagtcgtcctacgtaatcttctgaaacctcttcgcaatctgcatgatgcctcttcactgtgcaaataccttgaatcattctatactcttcggaagccggttgcttctacgataaatacattggctggtgctctatacaaggtcttcagtgcctcacctgacaaggctagagacgagatgcgccaagcttgctttgattacctaagccttggaggtgtctgctcgaatggtcctattgctctactctctggtcttaatcctcggccactgagcttggttgcacacttctttgccgttgctatctttggtgttggaagactaatgctccctcttccttcacctaaaaggatgtggattggggcgagattaatttcgggcgcatgtggtatcatcttcccgatcatcaaagctgaaggcgtgaggcaaatgttcttcccggctaccgtccccgcgtactaccgtgctcctccggaagcggagttctaaatggtgatgatgcagctgattcctcgcatggtgacatttttcttcttgttggtagccgttcatcagtgttagcatgcctgtgtttgtactgtccgaacagaatgaggaacctgtatagtatctcctgtgggtgattctttctgtgttgcaatgggtctgaactgttccatcggtatccatttcgattcgtcctaactaagttgtatatcagcggacattgaaccaatgccgatctaaccaattaatggcgctccttctgta

SEQ ID NO: 3689 - DNA, 2290 bp, Avena sativa
gaagaagaacatattccaagagaaaacaccagaaaatccagcggagccagccaggctacacgccagagacagccagctacacggacgacaggcaggggcggagagagagcggccatctaccccataaaaagagaccccagaatctccaactccaagcggtcgcctcgtctcgtcccaatcccctgttccgtttcgtcccgctccctccctccctcccgcacgcatcagcctcctcctcgaccccatcctcgcctagcctcgcccaacacagcccacacgtctccagacggaaacagacgccaccaccgccccgcgctgcgtcgagaaaacccctctgcccgaggaagttcttcctcattgcggcatggctgaggtcgccgccgtcgggcagctcggtggcgccgccaccgcggccacgctcctcgcggcgctcttcctcgccgtcctgtttcggcaccagagacggcggcggcagcgcggcgctccggtggaagggatccccgcgccggtggaccgctgcgcggtcgctgacggcgaagggattgccgccctggatggcccgacggacgtcatcatcgttggagccggggtggccggatctgcgctcgcctacacgctcggaaaggatggtcgccgggtgcatgttatagagagagacttgactgagccagatagaattgtcggtgaactattacaacctggaggctacctgaaattggttgaactgggtctccaggattgtgttgatgaaattgacgcacagcgtgttcttggttatgcattattcaaagatggaaagaacaccaagctttcttatcccttggaaaagttccattcagatgttgctggtaggagctttcacaatggacggtttatacagaggatgcgtgaaaaagctgcgtctttgcctaatgtccagttggagcaaggaacagttacttctttgcttgaagaaaatggtacagttaagggtgtacaatacaagaacaagtcaggtgaagaactaaaagctcatgcaccattgacaattgtatgtgatggttgcttttcaaatttacgacgtgcactttgttctccaaaggttgagtcgccatcttgttttgttggactggtcttggagaattgtgaacttcctcaccgaaatcacggccatgttatcttggccaatccttcaccgatcctattttacccaataagcagcactgaggttcgctgtttagttgatgtccctggtcagaaggtgccttccattgcaagtggtgaaatggcaaattatctcaagaccgtggttgcacctcagatccctccagaaatctatgattcctttgtagcagccattgacaagggaagcataagaacaatgccaaataggagcatggcagctgccccacatccaacacctggtgcacttttgatgggagatgctttcaatatgcgacaccctttaactggtggaggaatgacagttgcgttatctgatatagtcgtcctacgtaatcttctgaaacctcttcgcaatctgcatgatgcctcttcactgtgcaaataccttgaatcattctatactcttcggaagccggttgcttctacgataaatacattggctggtgctctatacaaggtcttcagtgcctcacctgacaaggctagagacgagatgcgccaagcttgctttgattacctaagccttggaggtgtctgctcgaatggtcctattgctctactctctggtcttaatcctcggccactgagcttggttgcacacttctttgccgttgctatctttggtgttggaagactaatgctccctcttccttcacctaaaaggatgtggattggggcgagattaatttcgggcgcatgtggtatcatcttcccgatcatcaaagctgaaggcgtgaggcaaatgttcttcccggctaccgtccccgcgtactaccgtgctcctccggaagcggagttctaaatggtgatgatgcagctgattcctcgcatggtgacatttttcttcttgttggtagccgttcatcagtgttagcatgcctgtgtttgtactgtccgaacagaatgaggaacctgtatagtatctcctgtgggtgattctttctgtgttgcaatgggtctgaactgttccatcggtatccatttcgattcgtcctaactaagttgtatatcagcggacattgaaccaatgccgatctaaccaattaatggcgctccttctgtactgaacctgggctctgtttgtgtgccattacactgatagtcctagtagttggactaattccac

SEQ ID NO: 3690 - DNA, 1969 bp, Brachypodium distachyon
ccgtccccattgccgcatggctgcggccgctggcttcgggccgctcgtgggcgccgcggcggctacgctcctcgcggcagtcttcctcgccgccgtgctagggcggcggcggcgccgccgggctccggtcgaagggagcaccgcgccggggggtggctgcgcggtcgctgacggagaagggcacgccgccgaggatggcacgacggacgtcatcatcgttggcgccggagtggccggatctgcgctcgcctacacgctcggaaaggatggtcggcgagtccatgttatagagagggacctgacagagccagatagaattgtgggtgaactgttacaacctggaggttacttgagattgatggaattgggcctgcaggactgtgttgacgaaattgatgcacaacgtgtccttggttatgcattattcaaagatgggaagaacacgaagctttcttaccccttggagaagttccattcagatgttgctggtaggagctttcacaatggacggtttatacagaggatgcgtcaaaaagcagcgtctttgcctaatgtgcagttggagcaaggaacagttacatctttgattgaagaaaatggtacagtcaagggtgtacaatacaagattaagtcaggtgaagaacaaaaagcttacgcaccattgacaattgtgtgtgatggctgcttttcaaatctacggcgtgccctttgctctccaaaggttgaggtgccatcttgttttgttgggctagtcttggagaattgtcaacttcctcatgcgaatcacggccatgttatcttggccaatccttcacccatcctattttacccaattagcagcaccgaggttcgctgtttggttgatgttcctggtcaaaaggtgccttccatagcaagtggtgacatggcaaattatctgaagaccgtggtagcacctcagattcctccagaaatctatgattcttttgtagcagccattgataagggaagcataagaacaatgccaaataggagcatgccagctgcaccacatccaacacctggtgcacttttgatgggggatgctttcaatatgcgacaccctttaactggtggaggaatgactgttgcattatctgacatagtcgtcctccgtaatcttctcaagcctcttcgtaatctgcatgatgcctcttctttgtgcaaataccttgaatccttctatacattgcggaagccggttgcctctacgataaacacattggcgggtgctctatacaaggtcttcagttcctcacccgacaaagctagggatgaaatgcgtcaagcttgctttgattacttgagccttggaggtgtctgttcgaatgggcctattgctctactctctggtcttaatcctcggccattgagtttggttgcacacttctttgctgttgctatctatggtgttggacgactgatgctccccgttccttcacctaaaagaatgtggatcggagcgaggttgatttcgggcgcatgtggcatcatcttccctatcatcaaagctgaaggcgtgaggcaaatgttcttccctgctactgtccctgcatattaccgggctcctcctgaagcggagttctgaacaatgacgatgctgctgatctggcacgatgacaattttcctgtgttgtagtcattcgtcagtgttcgcccctggtttgtactgtccggacggaacggagcaaggaacctgtatagtatctcccgtggccgtgggtgctgatcccgaatggtaaattgtacctgaactgctgcatcggtatccatgtcagtttttgttgactactaagctgtatatccttgttgaactgatgagccgatctaactagagttgtttcttgtctatcaaatctgagcttgtgctgcgtgcgtgggggactcgtgtatcagtggtccatcttttgtgtgtttgcaccattcaatttggatgctaaggttccctaaa

SEQ ID NO: 3691 - DNA, 2366 bp, Brachypodium distachyon
cagcagacccgccacgccatgacacggaccatgaccccgtttccaacctcttgcaaagctgctccgatcatatgctggtacagaaatatatttaggtgacaacatattcgaagaggaaaacaccagaaaaatccagcgaagccagagacagccagctacgcggacagggcggagagagcgatcttcccccctcctcccgcataaaaactggaagaatctttctcgagccggctcgcctcgcactctctctccctcccccccgctctcccgcacgcatcagcctcaagaaaacccagacgcaaaccaaacagacgcgccgagccgcgccgcgtcgagaaatcccgaggaaagccgtccccattgccgcatggctgcggccgctggcttcgggccgctcgtgggcgccgcggcggctacgctcctcgcggcagtcttcctcgccgccgtgctagggcggcggcggcgccgccgggctccggtcgaagggagcaccgcgccggggggtggctgcgcggtcgctgacggagaagggcacgccgccgaggatggcacgacggacgtcatcatcgttggcgccggagtggccggatctgcgctcgcctacacgctcggaaaggatggtcggcgagtccatgttatagagagggacctgacagagccagatagaattgtgggtgaactgttacaacctggaggttacttgagattgatggaattgggcctgcaggactgtgttgacgaaattgatgcacaacgtgtccttggttatgcattattcaaagatgggaagaacacgaagctttcttaccccttggagaagttccattcagatgttgctggtaggagctttcacaatggacggtttatacagaggatgcgtcaaaaagcagcgtctttgcctaatgtgcagttggagcaaggaacagttacatctttgattgaagaaaatggtacagtcaagggtgtacaatacaagattaagtcaggtgaagaacaaaaagcttacgcaccattgacaattgtgtgtgatggctgcttttcaaatctacggcgtgccctttgctctccaaaggttgaggtgccatcttgttttgttgggctagtcttggagaattgtcaacttcctcatgcgaatcacggccatgttatcttggccaatccttcacccatcctattttacccaattagcagcaccgaggttcgctgtttggttgatgttcctggtcaaaaggtgccttccatagcaagtggtgacatggcaaattatctgaagaccgtggtagcacctcagattcctccagaaatctatgattcttttgtagcagccattgataagggaagcataagaacaatgccaaataggagcatgccagctgcaccacatccaacacctggtgcacttttgatgggggatgctttcaatatgcgacaccctttaactggtggaggaatgactgttgcattatctgacatagtcgtcctccgtaatcttctcaagcctcttcgtaatctgcatgatgcctcttctttgtgcaaataccttgaatccttctatacattgcggaagccggttgcctctacgataaacacattggcgggtgctctatacaaggtcttcagttcctcacccgacaaagctagggatgaaatgcgtcaagcttgctttgattacttgagccttggaggtgtctgttcgaatgggcctattgctctactctctggtcttaatcctcggccattgagtttggttgcacacttctttgctgttgctatctatggtgttggacgactgatgctccccgttccttcacctaaaagaatgtggatcggagcgaggttgatttcgggcgcatgtggcatcatcttccctatcatcaaagctgaaggcgtgaggcaaatgttcttccctgctactgtccctgcatattaccgggctcctcctgaagcggagttctgaacaatgacgatgctgctgatctggcacgatgacaattttcctgtgttgtagtcattcgtcagtgttcgcccctggtttgtactgtccggacggaacggagcaaggaacctgtatagtatctcccgtggccgtgggtgctgatcccgaatggtaaattgtacctgaactgctgcatcggtatccatgtcagtttttgttgactactaagctgtatatccttgttgaactgatgagccgatctaactagagttgtttcttgtctatcaaatctgagcttgtgctgcgtgcgtgggggactcgtgtatcagtggtccatcttttgtgtgtttgcaccattcaatttggatgctaaggttccctaaatctggctctttctgccttgctaagatgagacgataagcaccacgca

SEQ ID NO: 3692 - DNA, 2005 bp, Panicum virgatum
cctctgtctccgtctcgcctcgtctcgcctcgaccccagaggcccagacgcatcaaaccgctctcctcctgtctcccctcgcaaccccaaagaagccgcactcgcaaaggcagcaaacgcgccgcgcaccggaagatcccagagagcggcacgaggggccccccattgcggcatggctgctgtggccgccggcgctggcgtcgggctccagctcattggcgcagccgcggccacgctcctagcggcggtccttgttgccgccgtgcttgggcgccgccgccggccgctggcccgggcgcctctggtggaagggaagcccgcgccggaggatggctgcgcggtcggcgacggcaagggcgccgccggtgacggtgggacggatgtcatcatcgttggcgctggagtagctggatctgcgctggcatatacgctcggaaaggatggccgtcgggtacatgttattgagagagatttgacagaacctgacagaattgtgggtgaactgttgcaacctgggggttacttgaaattaattgagttgggcctcgaagattgtgtggaagaaattgatgcccaacgtgtccttggttatgctttattcaaagatgggaggaacacaaagctcgcttaccccctggagaaattccattccgatgttgctggtaggagctttcacaatggaaggtttatacaaaggatgcgtcaaaaagccgcgtctttgcccaatgtccaattagagcaaggaactgttacatcgcttcttgaagaaaatggtaccgttaagggggtacaatacaaaaccaagtcaggtgaagaactaaaggcatttgcacccttgacgattgtatgtgatggctgcttttcgaatctacgacgtgccctttgctctccaaaggttgatgttccatcttgctttgttgggctggtcttggagaattgccaacttcctcacccgaaccatgggcatgttattttggccaatccttcgcccatcctattttacccaataagcagcactgaggtgcgttgtttggttgatgtccctggtcagaaggtgccatccatagcaagtggtgaaatggcaaattatctcaaaactgttgttgcacctcagattcctccagaaatctacgactcttttatagcggccattgataagggaagcataagaacaatgccaaataggagcatgccagctgcaccacatccaacccctggcgcacttttgatgggggatgcctttaatatgagacatcctttaactggtggaggaatgactgttgcgttatctgacattgttgtcctacgcaatcttctcaagcctcttcgcaatctgcatgacgcatcttccctgtgcaaataccttgaatcattctatacattgcggaagccggttgcttcaacgataaacacattggctggtgctctgtataaggtcttcagtgcctcgcctgatcaagctaggaatgagatgcgccaagcttgctttgattacttgagccttggaggtgtcttctcaaatgggcctattgctctactgtctggtcttaatcctcggccattgagtttagttgcacacttctttgctgttgctatctatggtgttggccgactgatgctccctcttccttcacctaaacgaatgtggattggagccaggctgatttctggtgcatgtggcatcatcctccctatcatcaaagctgaaggtgtgagacaaatgttcttccctgctaccgtgcctgcattctaccgggctgctcctgctgcagagtaaactggaactaggaaccgactctttgctgctgatctgatggcaactgctgtttcacggatggcatttttccagcgttagtggtcgttcgtcgtcattagccggttgtactgattcgagttggaaatgtgttgggtttcttctgtacgcatgtcgattcctgcaagttgtatatgattctgttgaactagtgaagtgaatacgtcgtcgtctttcacgctgatcgaactt

SEQ ID NO: 3693 - DNA, 2068 bp, Panicum virgatum
cgcccgccccgctctcctctgtctccgtctcgcctcgccccagagtcccagacgcatcaaaccgctcttctcctgtccttttctcccctctcaaccccaaagaagccgcactcgcaaaggcagcgaacgcgccgcgcaccggaagatcccagagagcggcacgagcggggccccattgcggcatggctgctgtggccgccggcgctggcgtcgggctccagctcattggcgccgccgcggccacgctcctagtggcggtccttgttgccgccgtgctggggcgccgccgccggccgccggcccgggcgcctctggtggaagggaagcccgcgccggaggatggccgcgcggtcggcgacggcgagggcgccgccggtgacggtgggacggacgtaatcatcgttggcgccggggtagctggatctgcgctggcatatacgctcggaaaggatggccgtcgggtacatgttattgagagagatctgacagaacccgacagaattgtgggtgaactgttgcaacctgggggttacttgaaattaatcgagttgggcctcgaagattgtgtggaagaaattgatgcccaacgtgtccttggttatgctttattcaaagatgggaggaacacaaagctcgcttatcccctggagaaattccattctgatgttgctggtaggagctttcacaatggaaggtttatacaaaggatgcgtcaaaaagccgcttctttgcccaatgtccaattagagcaaggaactgttacatcacttcttgaagaaaatggtaccgttaagggtgtacaatacaaaaccaagtcaggtgaagaactaaaggcttttgcacctttgacgattgtatgtgatggctgcttttcgaatttacgacgtgccctttgctctccaaaggttgatgttccgtcttgctttgttggactggtcttggagaattgccaacttcctcacccaaaccatgggcatgttatcttggccaatccttcgcccatcctattttacccaataagcagcactgaggtgcgttgtttggtcgatgtccctggtcagaaggtgccatccatagcaaatggcgaaatggcaaattatctcaaaactgttgttgcacctcagattcctccagaaatctatgactcttttatagcggccattgataagggaagcataagaacaatgccaaataggagcatgccagctgcaccacatccaacacctggcgcacttttgatgggggatgccttcaatatgagacatcctttaactggtggaggaatgactgttgcgttatctgacattgttgtcctacgcaatcttctcaagcctcttcgcaatctgcatgatgcatcttctctgtgcaaataccttgaatcattctatacattgcggaagccggttgcttcaactataaacacattggctggtgctctgtacaaggtcttcagtgcctcgcctgatcaagctaggaatgagatgcgccaagcttgctttgattacttgagccttggaggtgtcttctcgaatgggcctattgctctactttctggtcttaatcctcggccattgagtttagttgcacacttctttgctgttgctatctatggtgttggccgactgatgctccctcttccttcacctaaacgaatgtggattggagccaggctgatttctggtgcatgtggcatcatcctccctatcatcaaagctgaaggtgtgagacaaatgttcttccctgctaccgtgcctgcatactaccgggctgctccttctgcagagtaagctggaactaggaatcgactctttgctgctgatctgatggcaactgctgtttcacggatggcatttttcctgccttagtggtcgttcgtcgtcatcgttagccggttgttcgtgctgtcagtggaatcagaggaacctgtatagtgtctgcagcaggaacctgttattcgagttagaaatgtgttgggtttcttctgtacgcatgtcgattcctgccaagttgtatatgattctgttgaactagtgaagagatacgtcgttcgtcgtcttccacgctgatc

SEQ ID NO: 3694 - DNA, 2131 bp, Zea mays
ctcctctccagctctcctcccatataaaacgcggaagaatctcgaagagacgcctcgtcccatcgttcctctctctctgccccgcctacgcctcgccccagacgcatcaaaccgctctcctctccctccctgccccctcgcaaccccgaagaagccccccacacgcaaggccgcaaacgcgccgcgcaccggaaggccccagggagcgacacgaggcggcctcattgcggcatggctgctatggccgccgctggcggcgtcgggctccatctcattggcgctgccacggccacgctcatcgcggcggtccttgttgcggccgtgctggggcgccgccgccgggcccgggcccgggcccaggcgcctccggtggaagggaaacccgcgccggaggcaggctgcgcggtcggtgacggcgcgggtcccgacggcgggacggacgtcatcatcgtcggcgccggagtggctggatctgcgctggcgtacacgctcggaaaggatggccgccgggtgcatgtcatcgagagggatctgacagaacctgacagaattgtgggcgagctgttgcaacctggaggttacttgaaattaattgagttaggcctccaagattgtgtggaagaaattgatgcccaacgtgtgcttggttacgcattattcaaagatggaagaaacacaaagcttgcttatcccttagagaagttccattctgatgttgctggtaggagctttcacaatgggaggtttatacagaggatgcgtcagaaagctgcgtctttgcccaatgttcaattagaacaaggaactgttacatcacttctcgaagaaaatggtactgttaaaggtgttcaatacaaaaccaagtcaggtgaagaactaaaagcttatgcgcccttgacgattgtatgtgatggctgcttttcaaatctacggcgtgccctttgctctccaaaagttgatgttccatcatgttttattgggctggtattggagaattgccaacttccacatccaaaccatggccatgttatcttggccaatccttcgccaatactattttacccaattagcagcacagaggtgcgctgtttggttgatgtcccaggtcagaaggtgccttccatagctagcggtgaaatggcaaattatctcaaaaccgtcgttgcaccccagattcctccagaaatctatgactctttcatagcggccattgataagggaagcataagaacaatgccaaacaggagcatgccagcggctccacttcctacccctggcgcacttctgatgggggatgccttcaatatgagacaccctttaactggtggaggaatgactgttgcattatccgacatcgttgtcctacgtaatcttctcaagcctctccgcaatctccacgacgcatcttccctgtgcaagtacctcgaatcgttctatacgctgcggaagccggttgcctccaccataaacacgttggccggtgctctgtacaaggtcttcagcgcctcgcctgatcaagctaggaacgagatgcgccaggcctgttttgattacttgagcctcggaggcgtcttctcgaatgggcctattgccttactctcgggtcttaatcctcggccactgagtttagttgcacacttcttcgctgtcgctatctacggtgttggtcgcttgatgctccctcttccttcgcctaaacggatgtggattggagccaggctgatttctggtgcatgcggcatcatcctcccgatcatcaaagctgaaggcgtgagacagatgttcttccctgccactgtgcccgcatattaccgggctgcgcctacgggagaataagtaaagcgagaaccgattccgggctgctgcagtgctgctgatcccaccatgatctgatggcaactgatgtgtcatggatggcatttttttcctgtgttagtggttgttaggtggtttgttgtgctgctgtcattggaatgaggaacctgtatagtgtgcccctgggtactggtcaaagttgggaaatatccatgtcgattactgccaagctgtatatgattctgtcgaactagtgaaacctctccccatctttaacgcgtatcaatcttgtttgctcccccccccgagtacagca

SEQ ID NO: 3695 - DNA, 2031 bp, Saccharum officinarum
tctccgcccccgcctttcgccctcgagtcccagacgcatcaaaccgctcttctgtgtccctccctcccccctcgcaaccccaaaggagccccatacgcaaggcagcaaacgcaccccgcaccgaaagcacccagggagcggcacgaggaggccccattgcggcatggctgctgcggcggcagccgccggcgtcgggttccagctcattggcgccgccgcggccacgttcctcgcggcggtccttgtcgcggccgtgctggggcgccgccgccggccccggccccggccccaggcgcctctggtggaagggaaacccgcgccggaggcaggctgcgcggtcggcgacggcgggacggacgtcatcatcgtcggcgccggggtagctggatctgcgctggcgtacacgctcggaaaggatggccgtcgggtgcatgtcattgagagggatctgacagaacctgacagaattgtgggtgaactgttgcaacctgggggttacttgaaattaattgagttgggccttgaagattgtgtggaagaaattgatgcccagcgtgtccttggttacgcattattcaaagatggaaggaacacaaagcttgcttatcccttggagaagttccattctgatgttgctggtaggagctttcacaatgggaggtttatacagaggatgcgtcaaaaagctgcgtctttgcccaatgtccaattagagcaaggaactgttacatcacttcttgaagaaaatggtactattaaaggtgttcaatacaaaaccaagtcaggtgaagaactaaaagcttatgcgcccctgacgattgtatgtgatggctgcttttcgaatctacgacgcgctctttgctctccgaaggttgatgttccatcatgttttgttgggctcgtattggagaattgccaacttccacatccaaaccatggccatgttatcttggccaatccttctccaatcctattttacccaattagcagcacagaggtgcgctgtttggttgatgtccctggtcagaaggtgccttccatagctagcggtgaaatggcaaattatctcaaaactgttgttgctccccagattcctccagaaatctatgactctttcatagcggccattgataagggaagcataagaacaatgccaaataggagcatgccagcggctccacatccaacccctggtgcacttttgatgggggatgcattcaatatgagacatcctttaacaggtggaggaatgactgttgcattatctgacatcgttgtcctacgtaatcttctcaagcctcttcgcaatcttcatgacgcatcttccctgtgcaagtaccttgaatcgttctatacactgcggaagccggttgcttccacaataaacacattggccggtgctctgtacaaggtcttcagtgcctcgcctgatcaagctaggaatgagatgcgccaagcttgttttgattacttgagccttggaggcgtcttctcaaatgggcctattgctttactctctggtcttaatcctcgaccactgagtttagttgcacacttctttgctgttgctatctatggtgttggccgcttgatgctccctcttccttcacctaaacgaatgtggattggagccagactgatttctggtgcatgtggcatcatcctccctatcattaaagctgaaggcgtgagacagatgttcttccctgctactgtacccgcatattaccaggccgcaccaatgggagaataagcatggacagaaccgattccgtgctgctgatccgaccatgatctgatggcaactgatgtttcacggatggcatttttcctgtgttagtggttggttgttcgttgttgttagctggctgcttgtgctgtcaatggaatgaggaacctgtatagtgtgtgtcctgggtactggtaaagttggaaaatgtgttgggtttgttctgtactaatgtcgattactgccaagttgtatatggctctgtggaattagtgaacacgttgccttcctccacgctggtt

SEQ ID NO: 3696 - DNA, 2125 bp, Sorghum bicolor
agcccaccgctcctcaacctcctcctctcccataaaacgcggaagaatctcgaagagccgcctcgtcccatcgctcctctccctctctctccgccccgccccgccttcgcccgccccagagtcccagacgcatcaaaccactctcctcttcccctccctcccccccctctcgcaagccgcatacgcaaggccgcaaacgcgccgcgcaccggaaggtcccagggagcggcacgaggaggccccattgcggcatggctgctgctgctgcggcggcctccggcgtcgggttccagctcattggcgccgccgcggccacgctcctagcggcggtccttgttgcggccgttctggggcgccgccgccgccgggcccggccccaggcgcctctggtggaagccaaacccgcgccggagggaggctgcgcggtcggcgacggccggacggacgtcatcatcgtcggcgccggagtagctggatctgcgctggcatacacgctgggaaaggatggccgtcgggtgcatgtcatcgagagggatctgacagaacctgacagaattgtgggtgaactgttgcaacctgggggttacttgaaattaattgagttgggcctcgaagattgtgtggaagaaattgatgcccagcgtgtccttggttacgcattattcaaagatgggaggaacacaaagcttgcttatcccttggagaagttccattctgatgttgctggtaggagctttcacaatgggaggtttatacagaggatgcgtcaaaaagctgcgtctttgcccaatgtccaattagagcaaggaactgttacatcacttcttgaagaaaatggtactgttaaaggtgttcaatacaaaaccaagtcaggtgaagaactaaaagcttatgctcccctgacgattgtatgtgatggttgcttttcaaatctacgacgcgccctttgctctccaaaggttgatgttccatcatgttttgttgggctggtattggagaattgccaacttccacatccaaaccatggccatgttatcttggccaatccttctccaatcctattttacccaattagcagcacagaggtgcgctgtttggttgatgtccctggtcagaaggtgccttccatagctagcggtgaaatggcaaattatctcaaaactgttgttgcaccccagattcctccagaaatctacgactctttcatagcggccattgataagggaagcataagaacaatgccaaataggagcatgccagcggctccacatccgacccctggggcacttttgatgggggatgcattcaatatgagacaccctttaactggtggaggaatgactgttgcattatccgacattgttgtcctacgtaatcttctcaagcctctccacaatcttcatgacgcatcttccctgtgcaagtaccttgaatcgttctatacactgcggaagccggttgcttccacaataaacacattggccggcgctctgtacaaggtcttcagtgcctcgcctgatcaagctaggaatgagatgcgccaagcttgttttgattacttgagccttggaggcgtcttctcaaatgggcctattgctttactctccggtcttaatcctcggccactgagtttagttgcacacttctttgctgttgctatctacggtgttggccgcttgatgctccctcttccttcacctaagcgaatgtggattggagccagactgatttctggtgcatgtggcatcatcctccctatcattaaagctgaaggcgtgagacagatgttcttccctgctactgtacctgcatattaccgggccgcacctatgggagaataagcatgaacagagcaccgattccgtgctgctgatccgaccatgatatatgatggcaactgatgtttcacggatggcatttttcctgtattagttggttggttgttcgttgtgttagctggttgtatgtcccgtcattggaatgaggaacctgtatagtgtgtgccctggctactggtaagttagaaaatgtgttgggtttgttctgtatgcatgccgattattgccaagctgtacatgactctgttgaactagtaaaacgtccccttcttccatgctgatcaaac

SEQ ID NO: 3697 - DNA, 2516 bp, Sorghum bicolor
accaaataacacaaacctgtatccaccaaatttgaagaaatccagaaaatccagctaagccaagcccaccgctcctcaacctcctcctctcccataaaacgcggaagaatctcgaagagccgcctcgtcccatcgctcctctccctctctctccgccccgccccgccttcgcccgccccagagtcccagacgcatcaaaccactctcctcttcccctccctcccccccctctcgcaagccgcatacgcaaggccgcaaacgcgccgcgcaccggaaggtcccagggagcggcacgaggaggccccattgcggcatggctgctgctgctgcggcggcctccggcgtcgggttccagctcattggcgccgccgcggccacgctcctagcggcggtccttgttgcggccgttctggggcgccgccgccgccgggcccggccccaggcgcctctggtggaagccaaacccgcgccggagggaggctgcgcggtcggcgacggccggacggacgtcatcatcgtcggcgccggagtagctggatctgcgctggcatacacgctgggaaaggatggccgtcgggtgcatgtcatcgagagggatctgacagaacctgacagaattgtgggtgaactgttgcaacctgggggttacttgaaattaattgagttgggcctcgaagattgtgtggaagaaattgatgcccagcgtgtccttggttacgcattattcaaagatgggaggaacacaaagcttgcttatcccttggagaagttccattctgatgttgctggtaggagctttcacaatgggaggtttatacagaggatgcgtcaaaaagctgcgtctttgcccaatgtccaattagagcaaggaactgttacatcacttcttgaagaaaatggtactgttaaaggtgttcaatacaaaaccaagtcaggtgaagaactaaaagcttatgctcccctgacgattgtatgtgatggttgcttttcaaatctacgacgcgccctttgctctccaaaggttgatgttccatcatgttttgttgggctggtattggagaattgccaacttccacatccaaaccatggccatgttatcttggccaatccttctccaatcctattttacccaattagcagcacagaggtgcgctgtttggttgatgtccctggtcagaaggtgccttccatagctagcggtgaaatggcaaattatctcaaaactgttgttgcaccccagattcctccagaaatctacgactctttcatagcggccattgataagggaagcataagaacaatgccaaataggagcatgccagcggctccacatccgacccctggggcacttttgatgggggatgcattcaatatgagacaccctttaactggtggaggaatgactgttgcattatccgacattgttgtcctacgtaatcttctcaagcctctccacaatcttcatgacgcatcttccctgtgcaagtaccttgaatcgttctatacactgcggaagccggttgcttccacaataaacacattggccggcgctctgtacaaggtcttcagtgcctcgcctgatcaagctaggaatgagatgcgccaagcttgttttgattacttgagccttggaggcgtcttctcaaatgggcctattgctttactctccggtcttaatcctcggccactgagtttagttgcacacttctttgctgttgctatctacggtgttggccgcttgatgctccctcttccttcacctaagcgaatgtggattggagccagactgatttctggtgcatgtggcatcatcctccctatcattaaagctgaaggcgtgagacagatgttcttccctgctactgtacctgcatattaccgggccgcacctatgggagaataagcatgaacagagcaccgattccgtgctgctgatccgaccatgatatatgatggcaactgatgtttcacggatggcatttttcctgtattagttggttggttgttcgttgtgttagctggttgtatgtcccgtcattggaatgaggaacctgtatagtgtgtgccctggctactggtaagttagaaaatgtgttgggtttgttctgtatgcatgccgattattgccaagctgtacatgactctgttgaactagtaaaacgtccccttcttccatgctgatcaaacttggttgctccctgcttgggtacggcatgatgcagttttttttccccccgagtaggcgtactacggccggcaggactgacggccggcgagttctttggtgcttgcaaagcggaggattctattggcaaagatagcgcgcgagggtataactaggtaccagggcctttgagccgggccgatcggcaccagagtattcgggccgggccgatcctgcaactttaaggcccatagtgctttgttgctgtcgcgtatagcaagcgaacacgcataatttttccttttttctttctgacaggagagagcatcctgttgcgttgatacatgtggtg

SEQ ID NO: 3698 - DNA, 2259 bp, Setaria italica
aaaataaaccaaatttgcacacaaattcgaaaaatccagaaatccagctaagccaagcccgcccggccagctatgcagacatggctgcgagcggcctcaacctcctccccctccccataaaaagcggaagaatctcgaagagtcgtttcgtcccatcgcccaccacctccctctctcctcgccccagacgcatcaaatagctctccttctgtccctatctcctctcgcattcccaaagaagccccacaaggaagggagcaaacgcgccgcgcaccggaagatcccagagagcggcacgagggggcccccattgcggcatggctgctgcggccgccgccgccggcgccgggctccagctcattggagctgccgcggccacgctcctagcggcggtccttgttgccgccgtgctgggccgccgccgcgggtccgggccccggtcgccgctggtggaagagaaagccgcggcggaggctgcctgtgcgaccggtgacggcgcaggcgccgccggcgacggcgggtcggacgtcatcatcgtcggagccggggtagctggatctgcgctggcatacacgctcggaaaggatggccgtcgggtgcatgttattgagagagatctgacagaacctgacagaattgtgggtgaattgttgcaacctgggggttacttgaaattaatcgagttaggcctcgaagattgtgtggaagaaattgatgcccagcgtgtccttggttatgctttattcaaagatgggaggaacacaaagcttgcttatcccttggagaagttccattctgatgttgctggtagaagctttcacaatggaaggtttatacagaggatgcgtcagaaagctgcatctttgcccaatgtccaattagagcaaggaactgttacatcccttcttgaagaaaatggtacagttaagggtgttcaatacaaaaccaagtcaggtcaagaactaaaggcttatgcacccttgacaattgtatgtgatggctgcttttcaaatctacggcgtgccctctgctctccaaaggttgatgttccgtcttgctttgttgggttggtcttggagaattgccagcttccccacccaaatcatgggcatgttatcttggccaatccttcgcccatcctattttacccaataagcagcaccgaggtgcgttgtttggttgatgttcctggtcagaaggtgccttccatagcaagtggtgaaatggcaaattatctcaaaactgttgttgcaccccagattcctccagaaatctatgaatcttttatagcagccattgacaagggaagcataagaacaatgccaaataggagcatgccagctgccccacatccaacccctggtgcacttttgatgggggatgccttcaatatgagacatcctttaactggtggaggaatgactgttgcattatctgacattgttgtcctacgcaatcttctcaagcctcttcgcaatctgcatgatgcatcttccttgtgcaaataccttgaatcattctatacattgcggaagccggttgcttccacgataaacacattggctggtgctttatataaggtcttcagtgcctcgccagatcaagctaggaatgagatgcgccaagcttgctttgattacttgagccttggaggtgtcttctcaaatgggcctattgccctactttctggtcttaatcctcggccattgagtttagttgcacacttctttgctgttgctatctatggtgttggtcgcctgatgctccctcttccttcacctaaacgaatgtggattggagccagactgatttctggtgcatgtggcatcatcctccctatcatcaaagctgaaggcgtgagacaaatgttcttccctgctacggtgcctgcatactaccgggctgctcctaccgtagagtaagcaggaactaggaaccgactttgtgctgctgatgtgatcttgatctgatggcaactgttgtttcacggatgccatttttttctgtgttagtggtcgttcatcgtctttggtagccggttgttgaatgagaagaacctgtatagtgtctgccctgggtgctgattcgagctggtaatgtgttgggtttgttctgtacgcatgtcgattcctgccaagttgtatatgattctgttgaactagtgaagtgaatacgtcgtcgtctttcacgctgatcaaacttttggttgttccctgcctgctggactcccacggcacggtgcggttttcctgtgatctc

SEQ ID NO: 3699 - DNA, 2276 bp, Oryza sativa
agacgtcaaaatcgtatttttgggagttgggaaaaatccagcgatgcggaggaggagccgagccgagccagctatgaaaaccggagggaggagtcctcctcttcttcctccttcccctccgctcccgataaatcggaacaatctcgaagcatccgcccgtctccgcctgctcctcccaccaccaccaccgctgcttcccttctcccctctcgcccgccgccgcctcgccgcgacgcgcatcggcgccgccccacgaccgcagcagagaagcccaccaccacgcgcggagcggccgaggaggcctcaccactattggtgcgggatggcggaggtcgccgccggcaccgggcagctcattggcgtcgccgtggccacgctcctcgcggcgatcttcctcgccgccgcgcttcttggcagccgccggcgccggcggcgggcgccgttggcagggaagcctgcggccgtgggtggctgcggggtggccgacggcgaagggtgcggcggggatggccggaccgacgtcatcgtcgtcggagccggggtcgccggatctgcgctggcatacacgctcggaaaggatggccgtcgtgtgcatgttatagagagagacctaacagagcctgatagaattgtcggtgaactgttacaacctggtggctacctgaaattgatcgagttgggtctcgaggattgtgttcaagaaatagatgctcagcgtgtccttggttacgcgttattcaaagatgggaaagacacaaaactctcctatcccttggagaagttccactcagatgttgctggtaggagctttcacaatggacggtttatacagaggatgcgccagaaagctgcatctttgcctaatgttcaattggagcaaggaactgttacatcattggttgaagaagatggtacagttaagggtgttaaatacaagaccaagtcaggtgaagaattaaaagcatatgcacctctgacaattgtatgcgatggctgtttctcaaaccttcgccgcgccctttgctctccaaaggttgatgtaccatcttgttttgttgggctggtcctggagaattgtcaacttcctcatgcaaaccatggccatgttgtcctggccaatccttcacctatcctattttacccaataagcagcactgaagttcgctgtttggttgatgtccctggtcagaaggtgccttccatagcaaacggtgaaatggcaaaatatctcaaaacagtggttgcacctcagattcctccagaaatctatgattcattcatagcagccattgataagggaagcataagaacaatgccaaacaggagcatgccggctgctccacatccaacccctggtgcacttttgatgggtgatgcattcaacatgcggcatcctttgactggtggcggaatgactgttgcattatctgacattgttgtgctacgtaatcttctcaagcctctccgcaatctgcatgatgcatctgctctttgcaaataccttgaatcattctatacactgcggaagccggttgcttctaccataaacacattagctggtgctctatacaaggttttcagtgcctcacctgatcaggctaggaatgagatgcgccaagcctgctttgattacttgagccttggaggtgtcttttcaaatgggcctattgctcttctgtctggtctgaatcctcgaccattgagtttagtggcacatttctttgctgtcgctatctatggtgtcggtcgcctaatgcttcccctcccttcacctaaacgcatgtggatcggcgtaagactgatttccagtgcatgtggtataattttccccatcatcaaagctgaaggtgtgaggcatatgttcttccccgccactgtccctgcctattatcgtgctcctcgtccaatggagtaaggggggaaaatgaaaggagaagcgaagagaaaatccctgccactgtcctgatcggcggatgtttttcgtggatggcaattttcctgtgtaattggtagtagtcgtcaggccgtgaggttgtgtgtgctgttgttctaatggaacgaggggacctgtatacaccgtcacattccctgtacacttgccactttcgttgttccgtcagggatgcatgtcgactgctaatccttaagctgtatatcccccatgaattcatcatgattgcgtctttgctctaactgggtgcgttgctaatccactgaattccattgggtaggactcctgtgtgtgattgattgatacaactgtgtttgctagtaaa

SEQ ID NO: 3700 - DNA, 2174 bp, Oryza sativa
gccgagccgagccagctatgaaaaccggagggaggagtcctcctcttcttcctccttcccctccgctcccgataaatcggaacaatctcgaagcatccgcccgtctccgcctgctcctcccaccaccaccaccgctgcttcccttctcccctctcgcccgccgccgcctcgccgcgacgcgcatcggcgccgccccacgaccgcagcagagaagcccaccaccacgcgcggagcggccgaggaggcctcaccactattggtgcgggatggcggaggtcgccgccggcaccgggcagctcattggcgtcgccgtggccacgctcctcgcggcgatcttcctcgccgccgcgcttcttggcagccgccggcgccggcggcgggcgccgttggcagggaagcctgcggccgtgggtggctgcggggtggccgacggcgaagggtgcggcggggatggccggaccgacgtcatcgtcgtcggagccggggtcgccggatctgcgctggcatacacgctcggaaaggatggccgtcgtgtgcatgttatagagagagacctaacagagcctgatagaattgtcggtgaactgttacaacctggtggctacctgaaattgatcgagttgggtctcgaggattgtgttcaagaaatagatgctcagcgtgtccttggttacgcgttattcaaagatgggaaagacacaaaactctcctatcccttggagaagttccactcagatgttgctggtaggagctttcacaatggacggtttatacagaggatgcgccagaaagctgcatctttgcctaatgttcaattggagcaaggaactgttacatcattggttgaagaagatggtacagttaagggtgttaaatacaagaccaagtcaggtgaagaattaaaagcatatgcacctctgacaattgtatgcgatggctgtttctcaaaccttcgccgcgccctttgctctccaaaggttgatgtaccatcttgttttgttgggctggtcctggagaattgtcaacttcctcatgcaaaccatggccatgttgtcctggccaatccttcacctatcctattttacccaataagcagcactgaagttcgctgtttggttgatgtccctggtcagaaggtgccttccatagcaaacggtgaaatggcaaaatatctcaaaacagtggttgcacctcagattcctccagaaatctatgattcattcatagcagccattgataagggaagcataagaacaatgccaaacaggagcatgccggctgctccacatccaacccctggtgcacttttgatgggtgatgcattcaacatgcggcatcctttgactggtggcggaatgactgttgcattatctgacattgttgtgctacgtaatcttctcaagcctctccgcaatctgcatgatgcatctgctctttgcaaataccttgaatcattctatacactgcggaagccggttgcttctaccataaacacattagctggtgctctatacaaggttttcagtgcctcacctgatcaggctaggaatgagatgcgccaagcctgctttgattacttgagccttggaggtgtcttttcaaatgggcctattgctcttctgtctggtctgaatcctcgaccattgagtttagtggcacatttctttgctgtcgctatctatggtgtcggtcgcctaatgcttcccctcccttcacctaaacgcatgtggatcggcgtaagactgatttccagtgcatgtggtataattttccccatcatcaaagctgaaggtgtgaggcatatgttcttccccgccactgtccctgcctattatcgtgctcctcgtccaatggagtaaggggggaaaatgaaaggagaagcgaagagaaaatccctgccactgtcctgatcggcggatgtttttcgtggatggcaattttcctgtgtaattggtagtagtcgtcaggccgtgaggttgtgtgtgctgttgttctaatggaacgaggggacctgtatacaccgtcacattccctgtacacttgccactttcgttgttccgtcagggatgcatgtcgactgctaatccttaagctgtatatcccccatgaattcatcatgattgcgtctttgctctaactgggtgcgttgctaatccactgaattccattgggta

SEQ ID NO: 3701 - DNA, 1862 bp, Pennisetum glaucum
ggccgccggcgccggcgccgggctccagctcattggcgcagccgctgccacgctcctagcggtggtccttgttgccgccgtgctgggccgccgccgccggtccgggccccgatcgacgctggtgcaagagaaagccgcggcggaggctgcctgcgcggatgccgccggcgacggagggacggatgtcatcgtcgtcggagccggggtagctggatctgcgctggcatacacgctcggaaaggatggtcgtcgggtgcatgttattgagagagatctgacagaacctgacagaattgtgggtgaattgttgcaacctgggggttacttgaaattaatcgagttaggccttgaagattgtgtggaagaaattgatgcccagcgtgtacttggttatgctttattcaaggatgggaggaacacaaagcttgcttatcccttggagaagttccattctgatgttgccggtagaagctttcacaatggaaggttcatacagaggatgcgtcaaaaggctgcatctttgcccaatgtccaattagagcaaggaactgttacatctcttcttgaagaaaatggtacagttaagggtgttcaatacaaaaccaagtcaggtgaagaacgaaaggcttatgcacccttgacaattgtatgtgatggctgcttttcaaatctacggcgtgctctctgttctccaaaggttgatgttccgtcttgctttgttgggctggtcttggagaattgccagcttccccacccgaaccatgggcatgttatcttggccaatccttcacccatccttttttacccaataagcagcactgaggtgcgttgtttggtcgatgtccctggtcagaaggtgccctccatagcaagtggtgaaatggcaaattatctcaaaactgttgttgcaccccagattcctccagaaatctatgactcttttatagcggccattgacaagggaagcataagaacaatgccaaataggagcatgcctgctgctccacacccaacgcctggtgcacttttgatgggggatgcattcaacatgagacatcctttaactggtgggggaatgacggttgcattatctgacattgttgtcctacggaatcttctcaagcctcttcgcaatctgcatgatgcatcttccttgtgcaagtaccttgaatcattctatacattgcggaagccggttgcttccacgataaacacactcgctggtgctctgtataaggtcttcagtgcctcgcctgatcaagctaggaatgagatgcgccaagcttgctttgattacttgagccttggaggtgtattctcaaacgggcctattgctctactctctggtcttaatcctcgaccattgagtttagttgcacacttctttgctgttgctatctatggtgttggccgcctgatgctccctcttccttcacctaaacgaatgtggattggagccagactgatttctggtgcatgtggcatcatcctccctatcatcaaagctgaaggtgtgagacaaatgttcttccctgctaccgtgcctgcatactaccgggctgctcctaacgtagagtaagcaagaactaggaaccgactttgtgctgctgatgtgatcttgatctgatggcaactattgtttcacggatgacatttttcttgtgttagtcgttcgttcgttgtctttggtagccggttgttgtatgagaagaacctgtatagtgtctgcgggctgggactgtgttgggtttattctgtagtaagcttgtcgattcctgccaaagttgtatatgattctgttgaagttgaactagtgaagtgaatacctgtttcacgctgaacaaaaaaaaaaaaaaagtaaa

SEQ ID NO: 3702 - DNA, 2203 bp, Zea mays
aaaaaaaacccaaacctgcatacaattctgaagaaattcagaaaatccagctaagccaagttagtccgcccgccagctatgcggacatggttgcgagcggcctcaacctcctcctcctgacctcctcctcctcctccataaaatgcggaagaatctcgaagagtcccagacgcatcaaaccgccctcctctgtccctccctctcccgtctgccccctcgcatccccaaattaagccccgcgcgcaaggcagcaaacgcgccgcgcaccggaaggccccggggagctgcacgaggtggccccattgcggcatggctgctacggccgccgccgctggcgtcgagttcccgctcattggcgttgccgtggccacgctcatcgtgacggtccttgtcgcggccgtgatgcgccgccgccgccgtccctggcaccaggcgcctctggtggaggggaaacccgcaccagaggcaggctgcgcggtcagcgatggcgggacggacgtcatcatcgtcggcgccggggtagctggatctgcgctggcatacacgctcggaaaggatggccgtcgggtgcatgtcatcgagagggatctgacagaacctgacagaattgtgggcgagctgttgcaacctgggggttacttgaaattaattgagctgggcctccaagattgtgtggaagaaattgatgcccaacgcgtgcttggttacgcattattcaaagatggaaggaacacaaagcttgcttatcccctggagaagttccattctgatgttgctggtaggagctttcacaatgggaggtttatacagaggatgcgtcaaaaagctgcgtctttgcccaatgtccaattagagcaaggaactgttacctcacttcttgaagaaaatggtactgttaaaggtgttcaatacaaaaccaagtcaggtgaagaactaaaggcttatgcgcccttgacgattgtatgtgatggctgcttttcgaatctacgacgcgccctttgctctccaaaggttgatgtcccatcatgttttgttgggctggtattggagaactgccaacttccacatccaaaccatggccatgttatcttggccaatccttctccaatcttattttacccaattagcagcacagaggtgcgctgtttggttgatgtccctggtcagaaggtgccttccatagctaccggtgaaatggcaaactatctcaaaactgttgttgcaccccagattcctccagaaatctatgactctttcatagcagccattgataagggaagcatacggacaatgccaaacaggagcatgccagcggctccacatccgacccctggtgcacttctgatgggggatgcgttcaatatgagacaccctttaactggtggaggaatgactgttgcattatctgacatcgttgtcctgcgtaatctgctcaagcctctccgcaatcttcatgacgcatcttccctgtgcaagtaccttgaatcgttctatacactgcggaagccggttgcttccacaataaacacattggccggtgctctgtacaaggtcttcagtgcctcgcctgatcaagctaggaatgagatgcgccaggcttgttttgattacttgagcctcggaggcgtcttctcgaacgggcctatcgctttactctctggccttaaccctcggccactgagtttagttgcgcacttctttgctgttgctatctacggtgtcggccgcttgatgctccctcttccttcacctaaacgaatgtggattggagctagactgatttctggtgcatgcggcatcatcctccctatcatcaaagctgaaggcgtgagacagatgttcttccctgctacagtacccgcatattaccgggccgcacctacgggagaaaaggcatgaacagagaaccgattccgtgctgctggtccgaccatgaatgatctcatggcaactgatgtttcacggatgacatttttcctttgctagtggttagttattggttattgttagaccgtcgatggaatgaggaacctgtatagtgtttgtcctgggtactggtaaagttggaaaatgtgttgggtttgttctctacgcgtgtcgattgctgccaagttgtgcacgtagccacgtatgattctgttgagctagtgaaacgtccccttcttccacgctgatgaaacttggttgctccctggctgagtac

SEQ ID NO: 3703 - DNA, 3793 bp, Oryza sativa
gatcaatctcccgtacgtgcgctgctccttctctctcccgtgccgctgctccttctcctccgccgcttcttcagatcgatcccgtgctactgctgcttcctctcctcctcctcctcctcctccaggcggcgcaaatcgaggtgggacagggccgacgagatcccggaggacgtagagatggggatgggtgagatcgaggcggccggcgagctcacagcgacacggatcgagactgccggcgagctcccggcgccacggatcgagacggccggcgaactcccgaagggggcgcagatcgggatgggtgaagtcgtggtcgtcatcgccgtcattcgccggtttacctggtaagactacctccatggctgcgccgccgccgctgggctcctgctcgagctccccgcgaagggggtcgtgggaggaagggcgaggccacgacctccacaacgcggccgcgccgttctcccccacgccgcgcgccctcgagttgtcagatagttgcagaagaacgggtggccaaagtatgctccgcggacttggtttggtcgcgcgtgacgcctagctggctgcgaatctccgacgtgtcgagcgatggccgaatgacacgtcggagcactgtgaatggctatggtccaacatgccaagaggcccacgatctgcgatctgtaccatttaatattttcatcttctgtttggcttccggcgacggcgattgccagtctttgctcctcctgtctgttctgtctgctactgtttcttttatgcaaagttgcttggtccacagcactaaataaagccatggtatctatgatattcatggcattctttcatccgacgaacaattcctgcaagtagtagtcatatggcaagggccaaggggcatgtctgccagactgccacctactaataaccagtaaaaattatcacttcattaagcgccaagatccgtgcctggggatctcggactgtagcggcagaagaagaggtggtaatgcaatggccacagcctgtaaaactgggagccggacatggttttccggcctcgagattcgtgtggcgggggcgagatggacggctaccgtttgctcgctgaatcacgttgactcctgttgcgcaaagcagctccagctctgccaacacgagccacgccagcgaaagctgacgatgccattgccagctgctaatcagcggcggtccggccttttttcagctcacttcttctcccataaaacgtagtctcccgtcacctcgcttgcacttctctaagcttccacccacccacgtacgtacgcacgcagagcagcaagaaatggatgcggtcgccggcgccgggcagctcgttggcctcgccgcggccacgctcctcacggcggccttcctcgtcgcagtgaagatggggtggcggcgccgccgccgccaacgggaggtcgcgccggagggtggctgccgggttgttggcggcgatgggggtgaccggacggacatcgtcattgttggtgccggggtcgccggatctgcgctcgcctacacgctcggaaaggatgggcgacgagtgcatgttatagagcgggacatgacggagcctgatagaattgttggtgaactgctacagcctggtggctatttgaaattgatggagctgggtcttgaggattgtgttgaagaaatcgatgctcagcgtgtccttggttacgcattgttgaaagatgggagaaacacaaagctttcttatcccttggagaagttccattcagatgttgctggtaggagctttcacaatggacggtttatacagaagatgcgtcaaaaagctgcatctttgcctaatgttcatttggagcaaggaaccgttacatcattgctcgaagaaggtggcacggttaagggtgttcaatacaagacaaagtcaggtgaagaattaaaggcctatgcaccattgacaattgtatgcgatggctgtttctcaaacctacggcgtgtcctgtgctctccaaaggttgatgtgccatcctgttttgttgggttggttttggagaattgtcaacttcctcacccaaaccatggccatgttatcctggctaatccttcacctatcctatgttacccgataagcagcactgagattcgttgtttggttgatatccctgggcagaaggtgccttccatggcaaccggtgaaatggcaaaatatctcaagactgtggttgcacctcagattcctccagaactccatgattctttcattgcagcaattgataaaggaagcataaggacaatgccaaataggagtatgccagctgctccacttccaacccctggcgcgctgttgatgggtgatgcattcaacatgcgacatcctttaactggtggtggaatgaccgttgcgttttctgacattgttgtcctacgcaatcttctcaagcctctcggcaacctgcacgatgcaccttccctgtgcaagtaccttgaatcgttctatacactgcggaagcctgttgcttctacaatcaacacactggctggtgctctgtacaaggtcttctgtgcctcaactgaccaggctaagaatgagatgcgagaagcttgctttgattacttgagccttggaggagtcttctcaaatgggcctattgctcttctctctggcctcaatcctcggcctctgagtttagtagcccacttctttgctgttgctatctatggcgttggacgcctaatgctccccgtcccttcacctaaacgcatgtggatcggcgcgagactggtttccggtgcatgtggtatcatcttcccaatcatcaaagctgaaggtgtgaggcaaatgttcttccctgctacagtccctgcatattaccgggcccctcctccaatggaatccggataacgcatatcaatgctatcctgcatcgatcatgccgtttgtgtcccctgatctcggagctgctggaagcagaaaaaggaacagaagtaccgtgtttgtttcggcatcgaactcttcccttcaaacgtctaaatgcatgcacaggcgatatgacgtacacatacatgcagtaattaagcgccggtgggtatttggatatttggattagcatacccacgtggaggtcgtccaagaaaacgaccacttaacctcgtgtcaaaatcggcgtgtacttccgtttcgtgtcactgcagctagagtggcaaatttggccacttccctttcgttgccactgtgaactgctagctgcggctgtcctgctgctacttgcttcacgcgtgcgtgaaagtacattaggagaaatcaacatctgatgtttatggattgggaaaggaacaacgacgtcaaggctgtcacaacttaaaattaattgtaaacgttgtacatcaaaacagttgccttcaatcggctttgtgcataattgcattcaccgttcgcgtgcctagatgactgagtgactcggaattatgcatttgttcattagcgtactattcagttatctcaaagatttggcaatgacaagattttattggccacacagagattacgcagtaagatgatctgcatttgcttcctgttcgtccaaattccacttgcgctgtgatcactgtcgctacaggaagatatataaaacgacaataatctacattggatgacatgaggaataatcgggatccctttgcccataatccatccttaatctattgccactgtccatcctttcttgtcctcagccaggcccatctggatggacgtcagagtcgtgtgcagtgtctgcgataacgtgtcatgtccagtcctgaactcgtacct

SEQ ID NO: 3704 - DNA, 2396 bp, Hordeum vulgare
gagacagccagctacacggacagacatggcggagagagcgatctccctctcccctcccccccccataaaaaacggaacaatctccaactccaagcggccgcctctccctcgtctctcctctcctccccctccccgtcccaagtcccaatcccaccgcctggcactctcgcggccggctccgtttcgtccccgcacgcatcaccctcgccccaagaacccacacgcaaacccaacgaacgccgcgccgcgtcgagaaatccccaaggcccaagggacggcggccccagcaggagcaggtccccattgcggcatggctgcggccgccggcgtctggcagctcgttggcgccgccgcggccacgctcctcgcggcggtcctcgtcgccgtcgcgctggggcgccagcgccagcgccgccgcggggctccggcccaaggggtccccgcgccggaggacggctgcgcggtcgccgacggccaagggagcgcggccgtggacggcccgacggacgtcatcatcgttggtgccggggtggccggatctgccctcgcctacacgctcggaaaggatggtcgacgggtgcatgttatagagagagacctgacagagcccgatagaattgtgggtgaattgttacagcctggaggctacctgaaattgatggaattgggtctgcaggactgtgttgatgaaattgatgcacagcgtgtccttggttatgcattattcaaagatgggaagaacacaaaactttcttaccccttggagaagttccattcagatgtggctggcaggagctttcacaatggacgatttatacagaggatgcgtgaaaaagctgcatcattgcccaatgtccaactggagcaaggaacagttacatctttgcttgaagaaaatggtacagttaagggtgtgcaatacaagatcaagtcaggtgaagaactaaaagcttatgcaccattgacaattgtgtgcgatggctgcttttcgaacttaaggcgtgccctttgctctccaaaggttgaagtaccgtcttgctttgtagggcttgtcttggagaattgtcaacttcctcatgcgaaccatggccatgttatcttggccaatccttctcccatcctattttacccgataagcagcaccgaggttcgctgtttggtagatgtccctggccagaaggtgccctccatagcaagtggtgaaatggcaaattatctcaagaccgtggttgcacctcagattcctccagaaatctacgattcttttatagcagccattgataagggaagcataaggacaatgccaaataggagcatgccagctgcaccacatccaacacctggtgcacttttgatgggagatgctttcaatatgcgacaccctttaacaggtggaggaatgactgttgcattatcagatatagtcgtcttgcgtaatcttctcaagcctcttcgcaatctgcatgatgcctctgccctctgcaaatacctagagtcattctacactctacggaagccggttgcttctacaataaacaccttggctggtgctctatacaaagtcttcagtgcctcgcctgacaaggctagggacgagatgcgccaagcatgctttgattacttaagccttggaggtgtctgttcaaatgggcccattgctctactctctggtcttaatcctcggccattgagtttggttgcacacttctttgctgttgctatcttcggtgttggacggctgatgctcccccttccttcacctaaacgaatgtggactggagcgaggttgatctcgggcgcatgtggtatcatcttcccaattatcaaagctgaaggtgtgaggcaaatgttcttccctgctaccgtccccgcgtattaccgtgctcctcctgaagcggagttctgaagtacgaaggtgcagctaatctcttgcaccaaggcatttttcctgtgttggtagtcgttcgccagtgttagccggtcgttgaaatgtgttgtgttggtagtccgaatggatcgaggaacgtgtatagtatctccggtgggtgctgatcctgtctgttgaaatgttctgaattgctgcatcggtgcccatgttgattggtcctagttaaattgtacatttttgttgtactactacggtggtgtcccttgtctactgcgcgtgagctgtgctttctaaattctataaatcgtagtagaccactgtgtaccatgttaagctgaaccccgttatagaccatgatatgtcttcagttatacgggccagcccatcaaatgaggagccttatcccttatttagagtctcaattgattaagcaagtttgttagaaaagaatccattcagtttagagattctattagagtttaaataaacccaccgactcgtggtcttg

SEQ ID NO: 3705 - DNA, 1935 bp, Elaeis guineensis
ggtgggggagagagaaagagagcgcctgcgagaaggagatgcaggacgagtatctcgtcggagggattgttggcgcgatcttggggcttctcctcctcgttggaatccgggggagacggcggaggggtgacgggaatctggccggggcggcggccgccggcgggaaggtggaatgcggttcggaatccgccgggaacggcggtgccgacgttatcgtcgttggggctggcgtagccggatccgccctagcctttacgctcggaaaggatgcacgccgcgtacatgtaattgagagagatctgacagagcctgatcgaattgttggtgaattgttacaacctgggggctacctgaaattgattgagttgggccttgaggactgtgtgaaagaaattgatgctcagcgggtccttggctatgctctttataaagatggaaagaataccagactcccttaccctttggagaaattccattctgatgttgctggaaggagcttccacaatggccggttcatacagcggatgcgagagaaagctgcatctttgcccaatgttcagttagagcagggaactgtgacatctttgcttgaagaaaatgggatggtaaagggggtgtcatacaagactaagtccggtgaagagttaaaagcttatgcacctctaacaattgtgtgcgatggttgcttttccaatctgcgacgctctctctgctcaccgaaggtggaggtgccctcctgttttgttggtttagtcctggagaactgtcagcttccacatccaaaccatgggcatgttattttagcagatccttcgcccatccttttttatcctataagtagcactgaggtccgctgtttggttgatgtgcctgggcagaaggtgccttccatagctaatggggaaatgacaaattatctgaaaactgtggtggcacctcagcttccagttgaacttcatgatgcttttatatcggccatcgataaaggaagtataagaactatgccaaataggagcatgccagctgcacctcttcctacccctggagctcttttaatgggggatgcattcaatatgcgccatcctttaactggtggaggaatgaccgtggccttgtctgatattgttgtgctccgtaaccttctcaagcctctgcgcaatctgcatgatgcgacttctttgtgcaaatacctggaatctttctacaccttacgtaagccagttgcttctacaataaacactttggcaggtgctctgtacaaggtcttcagtgcctcccctgatcaggctaggaatgagatgcgccaagcctgttttgattatctaagccttggaggtgtgtgtacaaatggacccattgctttactctctggtcttaatccccgcccgctgagcttggtcgcccacttttttgctgttgctatatatggtgttggccgtttgttgttgccatttccttcacccaaacgattatgggttggagccagattgatctcaggtgcatcaggtatcatttttcctattataagagcagaaggggttaggcaaatgttcttccctgcaatggttcctgcatactacagagctcctcctatgaaatgaaattctgaaaaatatccataaccatggttgtactcatgatgggggtggtatatttcaactgttctattgacaggacgtgttttgtcagcttgtcttttctgaggatagatctgggatttgcaagtttaataattttgagagtgcttggactgcaacgactgttctgttctacatcgttttaataccgtaaaattcacagaactgttacataatcctggttaaagtttctaagttttgtcaacagtacttgtctgctgctgtgtttcctgtatttgtattaactccaaacatctctgtacttgaagcactaattcaattctgtcactcagtgaat

SEQ ID NO: 3706 - protein, 526 aa, Arabidopsis lyrata
MDPWSWICELPEAPEFSESDSHAVFQLAGDLTRSIKLRAERASGSDLESHSLTFKVVAEGFNLLKSSTIWVSDTCPLSSEKPFLPLVLQLLQELITHSPTSRAGACTKFEQLEIKPGPVSWVMDSHSPESFSSVFNLILLTRLFWLCVFDAPSEVGSFFFQHLLGPHVNALTCQHAPVLRTFLVSLGVDAELCIVRAASYALSKWMISKEIGLGNLGLKQLSSSLMPRHSLGFSYATEAHGLWILKGYFPILSMNVTNNSSNEVHNKIIKFPFVEPKEAVLRYALSHQQAEILVQFEYSVRFYENYIKVNARVDNIRIHVSKLGFNKGGVGVENQIADCYSEERYFPSRVRVWLGPELGSSHVSGLSLGKSTKNEERDIEVTRVLKGNFGKGKVAPRVKARARMSTKRKVKDWRIEQESEGNAAVFDAVLYDRESGQEVTTVMPKPNQEGLKNVFTKSGGMVFGRDAYGDEVGWRVGREMEGSVLKWRMGGKIWLTYWPNKLNTLFYETRCVEWCDEVDLPLLPTC

SEQ ID NO: 3707 - protein, 526 aa, Eutrema parvulum
MDPWSWICELPDSPEFAESESHAEFQLAGDSIRSILLRVERGSESDSESLSLIFKVIVEGFSRLKSSTIWVSDKCHLTSEKPFFPLVLQLLRELISRSPTTRDSTCTKSELLEIKPGPVNWVMDSHSPESFSSVFNLILLTRLFWLCVYNAPSEVGSFFFQHLLGPHVNSLTCQHAPVLRTFLVSLGVDAELCIVRAASYALSKWMISKEVGLGNLGLKQISNTLPRHSLGFSYATEAHGLWILKGYFPILSMSVTTNNNNSSNEVHNNKIIKFPIVEPKEAVLRYALSHQQAEVIVQFEYSVEFHENYIKVNARVDNIRIHVWKLGFHKGGGVENKIADCYSEEKYFPSRVKVWVGPEIGSSHVSGLSLGRSTKNEEREVEVTRVLKGNFGKGKVAPRVKARARMCTRRKIKDWRIEQESEGNAAVFDAVLYDRESGQEVTTVKPNHEGFKNAFTKSGGIVFGRDEYGDEVGWRVGREMEGSVLKWRIGGKIWLTYWPNKLNTSFYETRCVEWCDEIDLPLLPTS

SEQ ID NO: 3708 - protein, 523 aa, Eutrema halophilum
MDPWSWICELPESSEFAESDSPAVFQLAGDLTRSIQLTVERASGSDQESLSLIFKVIVKGFHRLKSSTIWVSDTCLLSSEKPFLPLVLQLLRELISHSPTTRDSACTKSDLLEVKPGPVNWVMDSHSPESFSSVFNLILLTRLFRLCAFDAPSEVGSFFFQHLLGPHVNSLTCQHAPVLKKFLVSVGVDPELCIVRAASYALSKWMISKEVGLENLGLKQLRSSLPRHPLGFSYATEAHGLWILKGYYPILSMNVTGNNSSNEVHNNIIKFPIVEPKEAVLRYALSHQQVEIIVQYDYSVRFHENYIKVNARVDNIRIHVSKLGLHKGGGMENQIADCYSEEKYFPSRVRVWVGPEIGSSHVSGLSLGRSTKNEEREVEVMRVLKGNFGKGKVAPRVKARARMSTRRKIKDWRIEQDSEGNAAVFDAVLYDRESGQEVTNVKPNPEGFKNVFTKSGGMVFGRDEYGDEVGWRVGREMEGSVLKWRMGGKIWLTYWPNKLNTSFYETRCVEWCDEVDFPLLHTS

SEQ ID NO: 3709 - protein, 524 aa, Brassica napus
MDPWSWICELPESHDFAESDTHAVFQLAGDLTHSIQLRVERASSSDLESLSLTFKVVVEGFSHLKSSTIWVSDTCALSSEKPFLPLVLLLLQELISYSPTTGESTCTKSEPLEIKSGPVSWVMDSHSPESFSSVFNLILLTRLFWLCVFDAPSEVGSFFFQHLLGPHVKSLTCQHAPVLRTFLVSLGVDAELCIVRAASYALSKWMISKEVGLGNLGLKQITSPLPHQSLGFSYATEAHGLWSLKGYFPILSMNLTNNNSSSEIHNNKIIKFPFVEPKEAVLRYALSHQHAEVIVQFEYSVTFHENYIKVNARVDNIRVHVSKLGFHKGRGMENQIADCYSDEKYFPSRVQVWVGPEIGSNHVSGLSLGRSTKNEEREVEVMRVLKGNFGKGKVAPRVKARARISTRRKIKDWRIDQESEGNAAVFDAVLYDRESGQEVVTVKPNQEGMKNVFTKSGGMVFGRDEYGDGAGWRVGREMEGSVLKWRMGGKIWLTYWPNKLCTSFYETRCVEWCDEVDLPLVPTS

SEQ ID NO: 3710 - protein, 524 aa, Brassica rapa
MDPWSWICELPESHDFAESDTHAVFQLAEDLTHSIQLRVERASSSDLESLSLTFKMVVEGFSHLKSSTIWVSDTCALSSEKPFLPLVLQLLQELISYSPTTGESTCTKSEPLEIKSGPVSWVMDSHSPESFSSVFNLILLTRLFWLCVFDAPSEVGSFFFQHLLGPHVKSLTCQHAPVLRTFLASLGVDAELCIVRAASYALSKWMISKEVGLGNLGLKQITSPLPHQSLGFSYATEAHGLWSLKGYFPILSMNLTNNISSSEMHNNKIIKFPFVEPKEAVLRYALSHQHAEVIVQFEYSVTFHENYIKVNARVDNIRVHVSKLGFHKGRGMENQIAECYSDEKYFPSRVQVWVGPEVGSNHVSGLSLGRSTKNEEREVEVMRVLKGNFGKGKVAPRVKARARISTRRKIKDWRIEQECEGNAAVFDAVLYDRESGQEVMTVKPNQEGMKNVFTKSGGMVFGRDEYGDGAGWRVGREMEGSVLKWRMGGKIWLTYWPNKLCTSFYETRCVEWCDEVDLPLVPTS

SEQ ID NO: 3711 - protein, 190 aa, Arabidopsis lyrata
MKNGNRKTTPETEKSHRRKLSEKAMSFHGRGTTPVSNPGELRRPKTLPELFSTGQSITGPVTESFPPRLTKLLLNVTVQGSLGAVQIIISPESTVSDLIDAAIRQYVKEARRPFLPESEPSRFDLHYSQFSLESIGREEKLISLGSRNFFLCGRKETGGFIGGGSSSESCSKEAEKVAKTGFHWLKFMGF

SEQ ID NO: 3712 - protein, 194 aa, Unknown
  Sequence found in Organisms: Brassica napus, Brassica rapa
MPVNSKTANRKGTTGETEKNRRGKLQEKAMSFHGRGTVPHSNPGELRRPKTLPELFSSGRTVVEPVSSKPPRLTKLLLNVTVQGSLGALQIIISPESTVDDLIDAAIRLYVKEARRPFLPESEPARFDLHYSQFSLESIGREQKLISLGSRNFFLCGRKENGGLVGSGTSESCSKEAEKVAAKTGFHWLKFMGF

SEQ ID NO: 3713 - protein, 194 aa, Brassica napus
MPVNSKNANRKGTTGETEKNRRGKLQEKAMSFHGRGTVPHSNPGELRRPKTLPELFSSGRTVVEPVSSKPPRLTKLLLNVTVQGSLGALQIIISPESTVDDLIDAAIRLYVKEARRPFLPESEPSRFDLHYSQFSLESIGREQKLISLGSRNFFLCGRKENGGLVGSGSSESCSKEAEKVAAKTGFHWLKFMGF

SEQ ID NO: 3714 - protein, 191 aa, Raphanus sativus
MPVNSKNANRKGETEKSRRGKLQEKAMSFHGRGTMPHPNPGELRRPKTLPELFSSGRTAVVEPVSSKPPRLTKLLLNVTVQGSSGALQIIISPESTVDDLIDAAIRLYVKEARRPFLPESEPSRFDLHYSQFSLESIGREQKLISLGSRNFFLCGRKENGGLVGSGSSESCSKEAEKAGKTGFHWLKFMGF

SEQ ID NO: 3715 - protein, 194 aa, Brassica napus
MPVNSKTANRKGTTGETEKNRRGKLQEKAMSFHGRGTVPYSNPGELRRPKTLPELFSSGRTVVEPVSSKPPRLTKLLLNVTVQGSLGALQIIISPESTVDDLIDAAIRLYVKEARRPFLPESEPARFDLHYSQFSLECIGREQKLISLGSRNFFLCGRKENGGLVGSGTSESCSKEAEKVAAKTGFHWLKFMGF

SEQ ID NO: 3716 - protein, 193 aa, Brassica juncea
MPINSKSANRKGATGETEKSRRGKLQEKAMSFHGRGTMPHSNPGELRRPKTLPELFSSGRTVVEPVSTKPPRLTKLLLNVTVQGSLGALQIIISPESTVDDLIDAAIRLYVKEARRPFLPASEPARFDLHYSQFSLESIGREQKLISLGSRNFFLCGRKENGGLVGSGTSESCSKEAEKVAKTGFHWLKFMGF

SEQ ID NO: 3717 - protein, 194 aa, Unknown
  Sequence found in Organisms: Brassica napus, Brassica oleracea
MPVNSKNANRKGTTGETEKNRRGKLQEKAMSFHGRGTVPHSNPGELRRPKTLPELFSSGRTVVEPVSSKPPRLTKLLLNVTVQGSLGALQIIISPESTVDDLIDAAIRLYVKEARRPFLPESEPSRFDLHYSQFSLESIGREQKLISLGSRNFFLCGRKENGGLVGSGSSESCSKEAEKVAAKTGFHWLKFMGL

SEQ ID NO: 3718 - protein, 514 aa, Arabidopsis lyrata
MEITTLIFLIISSVTFVIFLKLIFFSSTHKLPPGPPRFPVIGNIIWLKKNNFSDFQGVLRDLASRHGPIITLHVGSKPSIWVTDRSLAHQALVQNGAVFSDRPIALPTTKVITSNQHDIHSSVYGSLWRTLRRNLTSEILQPARVKAHAPSRKWSLEILVDLFETEQREKGHVSDALDHLRHAMFYLLALMCFGEKLKREEIREIEEAQYQMLISYTKFSVLNIFPSVTKFSLRRKWKEFLELRKSQENVILRYVNARSKETTGDVLCYVDTLLNLEIPTEEDKEGGKKRKLSESEIVSLCSEFLNAATDPTATAMQWIMAIMVKYPEIQRKVYDEMKSVLFAGEEEEREEIREEDLGKLSYLKAVILECLRRHPPGHYLSYHKVTHDTVLGGFLVPRQGTINFMVGEMGRDPKIWEDPLTFKPERFLENGEAYDFDMTGTRDIKMMPFGAGRRMCPGYALSLLHLEYYVANLVWKFEWKCVEGEEVDLSEKQQFITMVMKNPFKANIYPRRRK

SEQ ID NO: 3719 - protein, 503 aa, Brassica napus
MEIITIIFLTIISLIFIKLIFFSPPHKLPPGPPRFPVIGNIIWLKKNSFSDFQGVLRDLSSRHGPIITLHVGSKPSIWVTDRSLAHEALVQNGAVFSDRPLALPTTRVITSNQHDIHSSVYGSLWRTLRRNLTSEILQPARVKAHGPSRKWALEILVDLFETEQREKGFVSEALDHLRHAMFCLLALMCFGEKLKREEIREIEEAQYQMLISYTKFSVLNIFPSVTKFLLRRKWKEYLELRKSQESVLLKFVNARGRETSGDVLCYVDTLLNLEIPTEEDEGKKRKLSDSEIVSLCSEFLNAATDPTATAMQWILAIMVKYPEIQRKVYEEMKSVLEEGEEIREEDLGKLSYLKAVILESLRRHPPGHYLSYHKVTNDTVLGGFLVPRQGTINFMVGEMGRDPKIWEDPLTFKPERFLENGEAHGFDMTGTREIKMMPFGAGRRMCPGYGLSLLHLEYYVANLVWKFEWKCVEGEEVDLSEKQQFITMVMKTPFKANMYPRRK

SEQ ID NO: 3720 - protein, 503 aa, Brassica rapa
MEIITIIFLTIISLIFIKLIFFSPPHKLPPGPPRFPVIGNIIWLKKNSFSDFQGVLRDLASRHGPIITLHVGSKPSIWVTDRSLAHEALVQNGAVFSDRPLALPTTRVITSNQHDIHSSVYGSLWRTLRRNLTAEILQPARVKAHGPSRKWALEILVDLFETEQREKGFVSEALDHLRHAMFCLLALMCFGEKLRREEIKEIEEAQYQMLISYTKFSVLNIFPTVTKFLLRRKWKEYLELRKSQESVLLKFVNARGRETSGDVLCYVDTLLSLEIPTEEDEGKKRKLSDSEIVSLCSEFLNAATDPTATAMQWILAIMVKYPEIQRKVYEEMKSVLEEGEEIREEDLGKLSYLKAVILESLRRHPPGHYLSYHKVTNDTVLGGFLVPRQGTINFMVGEMGRDPKIWEDPLTFKPERFLENGEAHGFDMTGTREIKMMPFGAGRRMCPGYGLSLLHLEYYVANLVWKFEWKCVEGEEVDLSEKQQFITMVMKTPFKANMYPRRK

SEQ ID NO: 3721 - protein, 506 aa, Eutrema halophilum
MEIITVFFLIIISLSLSIFLKLIFFSPTHKLPPGPPRFPVIGNIIWLKKNSFSDFQGVLRDLASRHGPIITLHVGSKPSIWVTDRSLAHEALVQNGAVFADRPLALPTTRVITSNQHDIHSSVYGPLWRTLRRNLTSEILQPARVKAHAPSRKWALEILVDLLESEQRGKGHVSDALGHLRHAMFCLLALMCFGEKLKREEIREIEEAQYQMLISYTKFSVLNIFPSVTKFLLRRKWKEFFDLRKSQENVILRFVNARSREKAGDVLCYVDTLLGLEIPTEEEEGKKRKLSESEIVSLCSEFLNAATDPTATAMQWIMAIMVKYPEIQRKVYEEMKSVLAGEEEIREEDLGKLSYLKAVILESLRRHPPGHYLSYHKVTKDTVLGEFLVPRQGTINFMVGEMGRDPKIWEDPLTFKPERFLENGEAHGFDMTGTREIKMMPFGAGRRMCPGYSLSLLHLEYFVANLVWKFEWKCVEGEEVDLSEKQQFITMVMKTPFKANMYPRRK

SEQ ID NO: 3722 - protein, 506 aa, Eutrema parvulum
MEIITFFFISLSFAIFLKLIFFSPSHKLPPGPPRFPVIGNIIWLKKNSFSDFQGVLRDLASRHGPIVALHVGSKPSIWVTDRSLAHEALVQNGAVFSDRPLALPTTRVITSNQHDIHSSVYGSLWRTLRRNLTSEILQPARVKAHAPSRKWALEILVDLFESEQREKGHVSDALDHLRHAMFCLLALMCFGEKLKREEIREIEEAQYQMFISYTKFSVLNIFPSVTKFLLRRKWREFLDLRKSQENVILRFVNARGRETAGDVLCYVDTLLGLEIPTEEEEGKKRKLSESEIVSLCSEFLNAATDPTATAMQWIMAIMVKYPEIQRKVYEEMKSILAGEEEREEIREEDLGKLSYLKAVILESLRRHPPGHYLSYHKVTNDTVLGGFLVPRQGTINFMVGEMGRDPKIWEDPLTFKPERFLENGEAQGLDMTGTREIKMMPFGAGRRMCPGYSLSLLHLEYYVANLVWRFEWNCVEGEEVDLSEKQQFITMVMKNPFKANMYPRRK

SEQ ID NO: 3723 - protein, 78 aa, Brassica rapa
MVGQVMTRRVSSQTLQDHSFEITQLPQILFSDLFSFFQNTLHLLVHLPLYLRILHHDRQDPLHGRRGRIRSRVKKLRA

SEQ ID NO: 3724 - protein, 323 aa, Brassica napus
MFCLLALMCFGEKLKREEIKEIEEAQYQMLISYTKFSVLNIFPTVTKFLLRRKWKEYLELRKSQESVLLKFVNARGREASGDVLCYVDTLLSLEIPTEEDEGKKRKLSDSEIVSLCSEFLNAATDPTATAMQWILAIVVKYPEIQRKVYEEMKSVLEEGEEIREEDLGKLSYLKAVILESLRRHPPGHYLSYHKVTNDTVLSGFLVPRQGTINFMVGEMGRDPKIWEDPLTFKPERFLENGEAHGFDMTGTREIKMMPFGAGRRMCPGYGLSLLHLEYYVANLVWKFEWKCVEGEEVDLSEKQQFITMVMKTPFKANMYPRRK

SEQ ID NO: 3725 - protein, 305 aa, Eutrema parvulum
MEGTCTSIRPRLIGSCSIVELSRLINRAGVPFSVRISTRRRFRTRGQGGGFTAPASSREEGPSCIFVGPIDSARKETLEALYRQARDAYYNGKPLIVDDMFDRVELKLRWYGSKSVVKYPRCSLLRQSTYADAEDDASQVLLLATIWILILVFGSSACVLPTIYGLGLVYGGDPFDSGLVYGSQLSSSVPLLSKLNGILLTVLGPAFGYPIASSAVGVLKGLWRNDLTALKGNCPNCGEEVFAFVRSDQSNRSAHKADCHVCECTLEFRTKIELQKSASRLGRKWVYGRIYLVSRPRRDRCSKYT

SEQ ID NO: 3726 - protein, 299 aa, Arabidopsis lyrata
MKNNYNNSIKSNLMKDDEMFHVIHKVPCGDTPYVRAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEISRLLGNLGWAYMQQAKYLSAEAVYRKAQMVEPDANKSCNLAMCLIKQGRFEEGRLVLDDVLESRVLGADDCRTRQRAEELLSELESSLPRMGDAEMEDVLGNILDDDFVLGLEQMTSTSFKSKRLPIFEQISSFRNTLVC

SEQ ID NO: 3727 - protein, 306 aa, Unknown
  Sequence found in Organisms: Brassica napus, Brassica rapa
MERSLKKMKSNNTNSTRSNLMKDSELFHVIHKVPCGDTPYVKAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGETFNGKPTKTARSHGKKFQVTVQQEIARLLGNLGWAYMQQAKYLSAEAVYRKAQMVEPDANKSCNLAMCLIKQGRFEEGRSVLDDVLESRVLGADDCKTRQRADELLSELEASLPLRRDAEMENVLGNILDDDFVLGLEQITTTSFRSKRLPIFEQISSFRNQLVC

SEQ ID NO: 3728 - protein, 306 aa, Brassica rapa
MERSLKKMKNNNINSTRSNMMKDNELFHVIHKVPCGDTPYVKAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEISRLLGNLGWAYMQQAKYLSAEAVYRKAQIVEPDANKSCNLAMCLIKQGRFEEGRAILDDVLESKVSGSDDCKTRQRADELLSELEASLPRGRDAEMEDVLGNMLDDDFVLGFEERTATSFKSKRLPIFEQISPFRNQLVC

SEQ ID NO: 3729 - protein, 246 aa, Brassica napus
MERSLKKMKNNNINSTSNNMMKGNELFHVIHKVPCGDTPYVKAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEISRLLGNLGGHICNRPSTCRQKLYTEKPKLWSQTLTNLATSPCALSNKAGLKREERFLTMFSSLGFRVRMIVKQGNELLSF

SEQ ID NO: 3730 - protein, 227 aa, Brassica napus
MKNNNINSTRSNMMKDNELFHVIHKVPCGDTPYVKAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEISRLLGNLGWAYMQQAKYLSAEAVYRKAQIVEPDANKSCNLAMCLIKQGRLKKEERFLTMFSSLRFGFG

SEQ ID NO: 3731 - protein, 302 aa, Eutrema parvulum
MKNNNNNYTNSKRSNLMKDNELFHVVHKVPCGDTPYVKAKHAQLIEKNPEMAIVWFWKAINSGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEISRLLGNLGWAYMQQAKYLSAEAVYRKAQIVEPDANKSCNLAMCLIKQGRFEEARSVLEDVFESRVFGADDCRTRQRADELLNELEASLPLGRDSEMEDVLGNILDDDFVLGLEHMTTTNFKSKRLPIFEQISSFRNQLVC

SEQ ID NO: 3732 - protein, 298 aa, Brassica rapa
  misc_feature (11)..(11): Xaa can be any naturally occurring amino acid
  misc_feature (17)..(17): Xaa can be any naturally occurring amino acid
  misc_feature (20)..(20): Xaa can be any naturally occurring amino acid
LKKMKNNNTNXTRSNLXKDXELFHVIHKVPCGDTPYVKAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGETFNGKPTKTARSHGKKFQVTVQQEIARLLGNLGWAYMQQAKYLSAEAVYRKAQMVEPDANKSCNLAMCLIKQGRFEEGRSVLDDVLESRVLGADDCKTRQRADELLSELEASLPLRRDAEMENVLGNILDDDFVLGLEQITTTSFRSKRLPIFEQISSLRN

SEQ ID NO: 3733 - protein, 300 aa, Eutrema halophilum
MKNNNTNSPRSNQMNDKEMFHVIHKVPSGDTPYVKAKHAQLIDKNPEMAIVWFWKAINTGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEISRLLGNLGWAYMQQAKYLSAEAVYRKAQIVEPDANKSCNLAMCLIKQGRFEEGRSVLDDVFESRVLGADDCRTRQRADELLSELEASLPRRRDAEMEDVFGKILDDDFVLGLEQMTTTTSFRSKRLPIFEQISSFRNQLVC

SEQ ID NO: 3734 - protein, 299 aa, Brassica juncea
MKSNNTNSTRSNLVKDNELFHVIHKVPCGDTPYVRAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEIARLLGNLGWAYMQQAKYLSAEAVYRKAQIVEPDANKSCNLAMCLIKQGRFEEARALLDDVFTSRVLGADDCRTRQRADELLSELEASLPRRLDAEMEDVLGSILDDDFVMGLEEMTTSNYRTKRLPIFEQISSFRNQLVC

SEQ ID NO: 3735 - protein, 303 aa, Brassica napus
MKNNNTNSTRSNLMKDNELFHVIHKVPCGDTPYVKAKHAQLLEKNPEMAIVWFWKAINTGDRVDSALKDMAVVMKQLDRSEEAIEAIKSFRPRCSKNSQDSLDNVLIDLYKKCGRMEEQVELLKRKLRQIYQGETFNGKPTKTARSHGKKFQVTVQQEIARLLGNLGWAYMQQAKYLSAEAVYRKAQMVEPDANKSCNLAMCLIKQGRFEEGRSVLDDVLESRVLGADDRKTRQRADELLGELEVSLPLRRDAEMEDVLENILDDDFVLGLEQITTSSFRSKRLPIFEQISSFRSSFRNQLVC

SEQ ID NO: 3736 - protein, 301 aa, Brassica rapa
MKNNNTNTTRSNLVKDNELFHVIHKVPCGDTPYVKAKHAQLIEKNPEMAIVWFWKAINTGDRVDSALKDMAVVMKQLDRPEEAIEAIKSFRPRCSKNSQDSLDNVLIDLYKKCGRMEEQVELLKRKLRQIYQGEAFNGKPTKTARSHGKKFQVTVQQEIARLLGNLGWAYMQQAKYLSAEAVYRKAQMVEPDANKSCNLAMCLIKQGRFEEARALLDDVFTYRVLGADDCRTRQRADELLGELEASLPRRLDAEMEDVLGNILDDDFVIAIGLEEMTASNYRSKRLPIFEQISSFRNQLVC

SEQ ID NO: 3737 - protein, 301 aa, Brassica napus
MKNNNTNTTRSNLVKDNELFHVIHKVPCGDTPYVKAKHAQLIEKNPEMAIVWFWKAINTGDRVDSALKDMAVVMKQLDRPEEAIEAIKSFRPRCSKNSQDSLDNVLIDLYKKCGRMEEQVELLKRKLRQIYQGEAFNGKPTKTARSHGKKFQVTVQQEIARLLGNLGWAYMQQAKYLSAEAVYRKAQMVEPDASKSCNLAMCLIKQGRFEEARALLDDVFTSRVLGADDCRTRQRADELLSELEASLPRRLDAEMEDVLGNILDDDFVIAIGLEEMTASNYRSKRLPIFEQISSFRNQLVC

SEQ ID NO: 3738 - protein, 301 aa, Brassica napus
MKNNNTNTTRSNLVKDNELFHVIHKVPCGDTPYVKAKHAQLIEKNPEMAIVWFWKAINTGDRVDSALKDMAVVMKQLDRPEEAIEAIKSFRPRCSKNSQDSLDNVLIDLYKKCGRMEEQVELLKRKLRQIYQGEAFNGKPTKTARSHGKKFQVTVQQEIARLLGNLGWAYMQQAKYLSAEAVYRKAQMVEPDASKSCNLAMCLIKQGRFEEARALLDDVFTSRVLGADDCKTRQRAGELLSELEASLPRRLDAEMEDVFGNILDDDFVIAIGLEEMTASNYRSKRLPIFEQISSFRNQLVC

SEQ ID NO: 3739 - protein, 287 aa, Brassica juncea
MKNNNTNSTRSNLAKDNELFHVIHKVPCGDTPYVRAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEISRLLGNLGWAYMQQAKYLSAEAVYRKAQIVEPDANKSCNLAMCLIKQGRFEEGRAILDDVLESKVSGSDDCKTRQRADELLSELEASLPRGRDAEMEDVLGNMLDDDFVLGFEERTATSFKSKRLPIF

SEQ ID NO: 3740 - protein, 308 aa, Secale cereale
MDEQDQYESVGLDDSIEDERNLDEIMADRRAAEAELHARDVRTGATADRKLPRMLHDQDTDEDMNFRRPKRHRTNFRQPSGGPRTPRSDDDGDGLTPSSPGRSQPYSGGDVPMTDQTDDDGYEDEFDEEDEMNMYRVQGTLREWVTRDEVRRFIAKKFKEFLLTYVNPKNEQGDFEYVRLINEMVLANKCSLEIDYKQFIYIHPNIAIWLADAPQSVLEVMEEVGKNVVFDLHKNYRNIHQKIYVRITNLPVYDQIRNIRQIHLNTMIRIGVLLLEGQVCSLSCSRSSMTVANVELSWVLSSRTLTLK

SEQ ID NO: 3741 - protein, 872 aa, Triticum aestivum
MDEQDQYESVGLDDSIEDERNLDEIMADRRAAEAELHARDVRTGATADRKLPRMLHDQDTDEDMNFRRPKRHRANFRQPSGGPRTPRSDDDGDGLTPSSPGRSQPYSGGDVPMTDQTDDDGYEDEFDEEDEMNMYRVQGTLREWVTRDEVRRFIAKKFKEFLLTYVNPKNEQGEFEYVRLINEMVLANKCSLEIDYKQFIYIHPNIAIWLADAPQSVLEVMEEVGKNVVFDLHKNYRNIHQKIYVRITNLPVYDQIRNIRQIHLNTMIRIGGVVTRRSGVFPQLQQVKYDCSKCGTVLGPFFQNSYTEVKVGSCPECQSKGPFTVNIEQTIYRNYQKLTLQESPGIVPAGRLPRYKEVILLNDLIDCARPGEEIEVTGIYTNNFDLSLNTKNGFPVFATVVEANYVSKKQDLFSAYKLTDEDKAEIEKLSKDPRISERIVKSIAPSIYGHEDIKTAIALAMFGGQEKNVKGKHRLRGDINCLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPVGGRYDSSKTFTQNVELTDPIISRFDVLCVVKDIVDPFTDEMLARFVVDSHARSQPKGGNLEDRVVADEEDDPLTVARNADPDILSQDMLKKYITYAKLNVFPKIHDADLDKISHVYAELRRESSHGQGVPIAVRHIESIIRMSEAHAKMHLRSYVSQEDVDMAIRVLLDSFISTQKFGVQKALQKNFRKYMTYKKDYNELLLLLLRTLVKEALHFEEIVSGSTTRLTHVEVKVDDLKNKAQEYEIYDLRPFFSSSHFSDNSFVLDEGRGIIRHPVAA

SEQ ID NO: 3742 - protein, 872 aa, Triticum aestivum
MDEQDQYESVGLDDSIEDERNLDEIMADRRAAEAELHARDVRTGATADRKLPRMLHDQDTDEDMNFRRPKRHRANFRQPSGGPRTPRSDDDGDGLTPSSPGRSQPYSGGDVPMTDQTDDDGYEDEFDEEDEMNMYRVQGTLREWVTRDEVRRFIAKKFKEFLLTYVNPKNEQGEFEYVRLINEMVLANKCSLEIDYKQFIYIHPNIAIWLADAPQSVLEVMEEVGKNVVFDLHKNYRNIHQKIYVRITNLPVYDQIRNIRQIHLNTMIRIGGVVTRRSGVFPQLQQVKYDCSKCGTVLGPFFQNSYTEVRVGSCPECQSKGPFTVNIEQTIYRNYQKLTLQESPGIVPAGRLPRYKEVILLNDLIDCARPGEEIEVTGIYTNNFDLSLNTKNGFPVFATVVEANYVSKKQDLFSAYKLTDEDKAEIEKLSKDPRISERIVKSIAPSIYGHEDIKTAIALAMFGGQEKNVKGKHRLRGDINCLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPVGGRYDSSKTFTQNVELTDPIISRFDVLCVVKDIVDPFTDEMLARFVVDSHARSQPKGGNLEDRVVADEEDDPLTVARNADPDILSQDMLKKYITYAKLNVFPKIHDADLDKISHVYAELRRESSHGQGVPIAVRHIESIIRMSEAHAKMHLRSYVSQEDVDMAIRVLLDSFISTQKFGVQKALQKNFRKYMTYKKDYNELLLLLLRTLVKEALHFEEIVSGSTARLTHVEVKVDDLKNKAQEYEIYDLRPFFSSSHFSDNSFVLDEGRGIIRHPVAA

SEQ ID NO: 3743 - protein, 872 aa, Triticum aestivum
MDEQDQYESVGLDDSIEDERNLDEIMADRRAAEAELHARDVRTGATADRKLPRMLHDQDTDEDINFRRPKRHRANFRQPSGGPRTPRSDDDGDGLTPSSPGRSQPYSGGDVPMTDQTDDDGYEDEFDEEDEMNMYRVQGTLREWVTRDEVRRFIAKKFKEFLLTYVNPKNEQGEFEYVRLINEMVLANKCSLEIDYKQFIYIHPNIAIWLADAPQSVLEVMEEVGKNVVFDLHKNYRNIHQKIYVRITNLPVYDQIRNIRQIHLNTMIRIGGVVTRRSGVFPQLQQVKYDCSKCGTVLGPFFQNSYTEVRVGSCPECQSKGPFTVNIEQTIYRNYQKLTLQESPGIVPAGRLPRYKEVILLNDLIDCARPGEEIEVTGIYTNNFDLSLNTKNGFPVFATVVEANYVSKKQDLFSAYKLTDEDKAEIEKLSKDPRISERIVKSIAPSIYGHEDIKTAIALAMFGGQEKNVKGKHRLRGDINCLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPVGGRYDSSKTFTQNVELTDPIISRFDVLCVVKDIVDPFTDEMLARFVVDSHARSQPKGGNLEDRVVADEEDDPLTVARNADPDILSQDMLKKYITYAKLNVFPKIHDADLDKISHVYAELRRESSHGQGVPIAVRHIESIIRMSEAHAKMHLRSYVSQEDVDMAIRVLLDSFISTQKFGVQKALQKNFRKYMTYKKDYNELLLLLLRTLVKEALHFEEIVLGSTARLTHVEVKVDDLKNKAQEYEIYDLRPFFSSSHFSDNSFVLDEGRGIIRHPVAA

SEQ ID NO: 3744 - protein, 860 aa, Triticum aestivum
DDSIEDERNLDEIMADRRAAEAELHARDVRTGATADRKLPRMLHDQDTDEDINFRRPKRHRANFRQPSGGPRTPRSDDDGDGLTPSSPGRSQPYSGGDVPMTDQTDDDGYEDEFDEEDEMNMYRVQGTLREWVTRDEVRRFIAKKFKEFLLTYVNPKNEQGEFEYVRLINEMVLANKCSLEIDYKQFIYIHPNIAIWLADAPQSVLEVMEEVGKNVVFDLHKNYRNIHQKIYVRITNLPVYDQIRNIRQIHLNTMIRIGGVVTRRSGVFPQLQQVKYDCSKCGTVLGPFFQNSYTEVRVGSCPECQSKGPFTVNVEQTIYRNYQKLTLQESPGIVPAGRLPRYKEVILLNDLIDCARPGEEIEVTGIYTNNFDLSLNTKNGFPVFATVVEANYVSKKQDLFSAYKLTDEDKAEIEKLSKDPRISERIVKSIAPSIYGHEDIKTAIALAMFGGQEKNVKGKHRLRGDINCLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPVGGRYDSSKTFTQNVELTDPIISRFDVLCVVKDIVDPFTDEMLARFVVDSHARSQPKGGNLEDRVVADEEDDPLTVARNADPDILSQDMLKKYITYAKLNVFPKIHDADLDKISHVYAELRRESSHGQGVPIAVRHIESIIRMSEAHAKMHLRSYVSQEDVDMAIRVLLDSFISTQKFGVQKALQKNFRKYMTYKKDYNELLLLLLRTLVKEALHFEEIVSGSTTRLTHVEVKVDDLKNKAQEYEIYDLRPFFSSSHFSDNSFVLDEGRGIIRHPVAA

SEQ ID NO: 3745 - protein, 872 aa, Brachypodium distachyon
MDEQDQYESVGLDDSIEDERNLDEIMADRRAAEAELHARDVRTGATADRKLPRMLHDQDTDDDDMNFRRPKRHRASFRPPGGPRTPRSDDDGDGATPSSPGRSQPYSGGDVPTTDQTDDDGYEDEFDEEDEMNMYRVQGTLREWVTRDEVRRFIAKKFKEFLLTYENPKNEQGEFEYVRLINEMVLANKCSLEIDYKQFIYIHPNIAIWLADAPQSVLEVMEEVGKNVVFDLHKNYRNIHQKIYVRITNLPVYDQIRNIRQIHLNTMIRIGGVVTRRSGVFPQLQQVKYDCSKCGTILGPFFQNSYTEVRVGSCPECQSKGPFTVNIEQTIYRNYQKLTLQESPGIVPAGRLPRYKEVILLNDLIDCARPGEEIEVTGIYTNNFDLSLNTKNGFPVFATVVEANYVAKKQDLFSAYKLTDEDKAEIEKLSKDPHISERIIKSIAPSIYGHEDIKTAIALAMFGGQEKNVKGKHRLRGDINVLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPVGGRYDSSKTFTQNVELTDPIISRFDVLCVVKDIVDPFTDEMLARFVVDSHARSQPKGANLEDRVVADEEDDPLTVARQADPDILSQDMLKKYITYAKLNVFPKIHDADLDKISHVYAELRRESSHGQGVPIAVRHIESIIRMSEAHAKMHLRSYVSQEDVDMAIRVLLDSFISTQKFGVQKALQKNFRKYMTYKKDYNELLLLLLRTLVKDALHFEEIVSGSTTCLTHIEVKVDDLKNKAQEYEIYDLKPFFSSTHFKDNSFVLDEGRGIIRHPIAA

SEQ ID NO: 3746 - protein, 840 aa, Triticum aestivum
EAELHARDVRTGATADRKLPRMLHDQDTDEDMNFRRPKRHRANFRQPSGGPRTPRSDDDGDGLTPSSPGRSQPYSGGDVPMTDQTDDDGYEDEFDEEDEMNMYRVQGTLREWVTRDEVRRFIAKKFKEFLLTYVNPKNEQGEFEYVRLINEMVLANKCSLEIDYKQFIYIHPNIAIWLADAPQSVLEVMEEVGKNVVFDLHKNYRNIHQKIYVRITNLPVYDQIRNIRQIHLNTMIRIGGVVTRRSGVFPQLQQVKYDCSKCGTVLGPFFQNSYTEVRVGSCPECQSKGPFTVNIEQTIYRNYQKLTLQESPGIVPAGRLPRYKEVILLNDLIDCARPGEEIEVTGIYTNNFDLSLNTKNGFPVFATVVEANYVSKKQDLFSAYKLTDEDKAEIEKLSKDPRISERIVKSIAPSIYGHEDIKTAIALAMFGGQEKNVKGKHRLRGDINCLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPVGGRYDSSKTFTQNVELTDPIISRFDVLCVVKDIVDPFTDEMLARFVVDSHARSQPKGGNLEDRVVADEEDDPLTVARNADPDILSQDMLKKYITYAKLNVFPKIHDADLDKISHVYAELRRESSHGQGVPIAVRHIESIIRMSEAHAKMHLRSYVSQEDVDMAIRVLLDSFISTQKFGVQKALQKNFRKYMTYKKDYNELLLLLLRTLVKEALHFEEIVLGSTARLTHVEVKVDDLKNKAQEYEIYDLRPFFSSSHFSDNSFVLDEGRGIIRHPVAA

SEQ ID NO: 3747 - protein, 873 aa, Oryza sativa
MDEQDQYESVGLDDSIEDERNLDEIMADRRAAEAELDARDVRTGAAPDRKLPRMLHDQDTDEDMSFRRPKRHRANFRPPREPRTPRSDDDGDGATPSSPGRSQRGMYSGGDVPMTDQTDDDPYEDEFDEEDEMNMYRVQGTLREWVTRDEVRRFIAKKFKEFLLTYVNPKNEQGEFEYVRLINEMVLANKCSLEIDYKQFIYIHPNIAIWLADAPQSVLEVMEEVAKNVVFDLHKNYRNIHQKIYVRITNLPVYDQIRNIRQIHLNTMIRIGGVVTRRSGVFPQLQQVKFDCSKCGTVLGPFFQNSYTEVKVGSCPECQSKGPFTINVEQTIYRNYQKLTLQESPGIVPAGRLPRYKEVILLNDLIDCARPGEEIEVTGIYTNNFDLSLNTKNGFPVFATVVEANYVAKKQDLFSAYKLTDEDKAEIEKLAKDPRIGERIVKSIAPSIYGHEDIKTAIALAMFGGQEKNVKGKHRLRGDINVLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTFTQNVELTDPIISRFDVLCVVKDIVDPFTDEMLARFVVDSHARSQPKGANLEDRVPTDVEDDPLAAARQADPDILSQDMLKKYITYAKLNVFPKIHDADLDKISHVYAELRRESSHGQGVPIAVRHIESIIRMSEAHARMHLRSYVSQEDVDMAIRVLLDSFISTQKFGVQKALQKNFRKYMTYKKDYNELLLLLLRTLVKDVLHFEEIVSGPTTRLTHIEVKVEDLKNKAQEYEIYDLRPFFSSAHFRDNNFVLDEGRGIIRHPLAA

SEQ ID NO: 3748 - protein, 872 aa, Setaria italica
MDEHDQYESVGLDDSLEDERNLDEIMADRRAAEVELDARDVRTGPAADRKLPRMLHDQDTDEDMNFRRPKRHRTSFRPPSGPRTPRSDDDGDGATPSSPGRSQRGYSGGDVPMTDQTDDDPYEDEFDEEDEMNMYRVQGTLREWVTRDEVRRFIAKKFKEFLLTYVNPKNEQGEFEYVRLINEMVLANKCSLEIDYKQFIYIHPNIAIWLADAPQSVLEVMEEVAKNVIFDLHKNYRNIHQKIYVRITNLPVYDQIRNIRQIHLNTMIRIGGVVTRRSGVFPQLQQVKYDCSKCGTILGPFFQNSYTEVKVGSCPECQSKGPFTVNVEQTIYRNYQKLTLQESPGIVPAGRLPRYKEVILLNDLIDCARPGEEIEVTGIYTNNFDLSLNTKNGFPVFATVVEANYVAKKQDLFSAYKLTDEDKAEIEKLSKDPRIGERIVKSIAPSIYGHEDIKTAIALAMFGGQEKNIKGKHRLRGDINVLLMGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTFTQNVELTDPIISRFDILCVVKDIVDPFTDEMLARFVVDSHARSQPKGANLEDRVPTDVNDDPLAAARQADPDVLSQDMLKKYITYAKLNVFPKIHDADLDKISHVYAELRRESSHGQGVPIAVRHIESIIRMSEAHARMHLRSYVSQEDVDMAIRVLLDSFISTQKFGVQKALQKNFRKYMTYKKDYNELLLLLLRTLVKDALHFEEIVSGATSRLTHVEVKVEDLKNKAQEYEIYDLKPFFSSAHFRDNSFILDEGRGIIRHPVAA

SEQ ID NO: 3749 - protein, 873 aa, Saccharum officinarum
MDEHDQYESGGLDDSLEDERNLDEIMADRRAAEAELDARDVRTGAAADRKLPRMLHDQDTDEDMNFRRPKRHRASFRPPSGPRTPRSDDDGDGATPSSPGRSQRGMYSGGDVPMTDQTDDDPYEDEFDEEDEMNMYRVQGTLREWVTRDEVRRFIAKKFKEFLLTYVNPKNDQGEIEYVRLINEMVLANKCSLEIDYKQFIYIHPNIAIWLADAPQSVLEVMEEVAKNVVFDLHKNYRNIHQKIYVRITNLPVYDQIRNIRQIHLNTMIRIGGVVTRRSGVFPQLQQVKYDCSKCGTILGPFFQNSYTEVKVGSCPECQSKGPFTVNVEQTIYRNYQKLTLQESPGIVPAGRLPRYKEVILLNDLIDCARPGEEIEVTGIYTNNFDLSLNTKNGFPVFATVVEANYVAKKQDLFSAYKLTDEDKAEIEKLSKDPRIGERIVKSIAPSIYGHEDIKTAIALAMFGGQEKNVKGKHRLRGDINVLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTFTQNVELTDPIISRFDVLCVVKDIVDPFTDEMLARFVVDSHARSQPKGANLEDRVSTDVDDDPLAAARQADPDVLSQDMLKKYITYAKLNVFPKIHDADLDKISHVYAELRRESSHGQGVPIAVRHIESIIRMSEAHARMHLRSYVSQEDVDMAIRVLLDSFISTQKFGVQKALQKNFRKYMTFKKDYNELLLLLLRTLVKDALHFEEIMSGSTSRLTHVEVKVEDLRNKAQEYEIYDLKPFFSSAHFRDNSFVLDEGRGIIRHPLAE

SEQ ID NO: 3750 - protein, 873 aa, Sorghum bicolor
MDEHDQYESVGLDDSLEDERNLDEIMADRRAAEVELDARDVRSGTAADRKLPRMLHDQDTDEDMNFRRPKRHRASFRPPSGPRTPRSDDDGDGATPSSPGRSQRGMYSGGDVPMTDQTDDDPYEDEFDEEDEMNMYRVQGTLREWVTRDEVRRFIAKKFKEFLLTYVNPKNDQGDIEYVRLINEMVLANKCSLEIDYKQFIYIHPNIAIWLADAPQSVLEVMEEVAKNVIFDLHKNYRNIHQKIYVRITNLPVYDQIRNIRQIHLNTMIRIGGVVTRRSGVFPQLQQVKYDCSKCGTILGPFFQNSYTEVKVGSCPECQSKGPFTVNVEQTIYRNYQKLTLQESPGIVPAGRLPRYKEVILLNDLIDCARPGEEIEVTGIYTNNFDLSLNTKNGFPVFATVVEANYVAKKQDLFSAYKLTDEDKTEIEKLSKDPRIGERIVKSIAPSIYGHEDIKTAIALAMFGGQEKNVRGKHRLRGDINVLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKTFTQNVELTDPIISRFDVLCVVKDIVDPFTDEMLARFVVDSHARSQPKGANLEDRVSTDVDDDPLAAARQADPDVLSQDMLKKYITYAKLNVFPKIHDADLDKISHVYAELRRESSHGQGVPIAVRHIESIIRMSEAHARMHLRSYVSQEDVDMAIRVLLDSFISTQKFGVQKALQKNFRKYMTFKKDYNELLLLLLRTLVKDALHFEEIMAGSTSRLTHVEVKVEDLKNKAQEYEIYDLKPFFSSAHFRDNSFLLDEGRGIIRHPLAE

SEQ ID NO: 3751 - protein, 879 aa, Zea mays
MDEHDQYESVGLDDSLEDERNLDEIMADRRAAEAELDAREVRTGATADRKLPRMLHDQDTDDDTNFRRPKRHRASFRQPSGPRTPRSDDDGDGATPSSPGRSHRGMSSGGDVPMTDQTDDDPYEDEFDEEDEMNMYRVQGTLREWVTRDEVRRFIAKKFKEFLLTYVHPKNDQGEFEYVRLINEMVLANKCSLEIDYKQFIYIHPNIAIWLADAPQSVLEVMEEVAKNVVFDLHKNYRNIHQKIYVRISNLPVYDQIRNIRQIHLNTMIRIGGVVTRRSGVFPQLQQVKYDCNKCGTILGPFFQNSYTEVKVGSCPECQSKGPFTVNVEQACYLKHTIYRNYQKLTLQESPGIVPAGRLPRYKEVILLNDLIDCARPGEEIEVTGIYTNNFDLSLNTKNGFPVFATVVEANYVAKKQDLFSAYKLTDEDKAEIEKLSKDPRIGERIIKSIAPSIYGHEDIKTAIALAMFGGQEKNVKGKHRLRGDINVLLLGDPGTAKSQFLKYVEKTGHRAVYTTGKGASAVGLTAAVHKDPVTREWTLEGGALVLADRGICLIDEFDKMNDQDRVSIHEAMEQQSISISKAGIVTSLQARCSVIAAANPVGGRYDSSKTFTQNVELTDPIISRFDVLCVVKDIVDPFTDEMLARFVVDSHARSQPKGANLEDRVSTDVDDDPLAAARQADPDVLSQDMLKKYITYAKLNVFPKIHDADLDKISHVYAELRRESSHGQGVPIAVRHIESIIRMSEAHARMHLRSYVSQEDVDMAIRVLLDSFISTQKFGVQKALQKNFRKYMTFKKDYNELLLLLLRTLVKDAVHFEEIMAGSASRLTHVEVKLEDLRNKAQEYEIYDLKPFFSSACFRDNGFLLDEGRGIIRHPLAE

SEQ ID NO: 3752 - protein, 867 aa, Musa acuminata
MDDQDRYETVGMDDSMEDERDLDQIMADRRAAEVELDVRDGRNGGILDRKLPQMLYDQDMDDDINFRRPKRFRADFRPPAGGRSEDDTEGSTQSSPGRFQRGHSRDDVPVTDQTDDDQYEDEYDGEDDIMCHVQGTLREWVTRDEVRRFIAKKFKDFLLTYVNPKNEHGDIEYVRLINEMVLANKCSLEIDYKQFIYTEANIAIWLADAPQSVLEVMEEVAKNVVFDMHKNYKNIHQKIFVRITNLPVYDQIRNIRQIHLNTMIRIGGVVTRRSGVFPQLQQVKYDCNKCGAILGPFFQNSYSEVKVGSCPECQSKGPFTINVEQTIYRNYQKLTLQESPGIVPAGRLPRYKEVILLNDLIDCARPGEEIEVTGIYTNNFDLSLNTKNGFPVFATVVEANYVTKKQDLFSAYKLTDEDKAEIEKLAKDPRIGERIVKSIAPSIYGHEDIKMAIALAMFGGQEKIVQGKHRLRGDINVLLLGDPGTAKSQFLKYVEKTGHRAVYTTGKGASAVGLTAAVHKDPVTREWTLEGGALVLADRGVCLIDEFDKMNDQDRVSIHEAMEQQSISISKAGIVTSLQARCSVIAAANPVGGRYDSSKTFTQNVELTDPIISRFDILCVVKDIVDPVTDEMLARFVVDSHAKSQPKGATLEDQPASNTQDELASSRPVDPEILSQDMLKKYITYAKLNVFPKLHDADLDKFKHVYADIRRESSHGQGIRIAVRHIESMIRMSEAHARMHLRNYVCQEDEDMAIRVLLDSFISSQKFGVQKALQKSYRKYMTFKKDFNELLLHLLRILVKDALHFEEIVSGTTARLTHIEVKVEELRNKAQEYEIYDLKPFFSSAHFTSSNFILDESRGVIKHPLAR

SEQ ID NO: 3753 - protein, 865 aa, Quercus alba
MDEQGPVRVGGLDDSLEDERDLDQIMQDRRAADLELDAREVRVTGRKLPELLHDQDTDDDNYRPSKRSRADFRPPPVPRSYDDNDGMQSSPGRSQRGHSREDVPMTDQTDDDQYEDEDDDEGEFEMYRVQGTLREWVTRDEVRRFIAKKFKDFLLTYVNPKNEHGDFEYVRLINEMVSANKCSLEIDYKQFIYIHPNIAIWLADAPQSVLEVMEDVAKNVVFNLHPNYKNIHQKIYVRITNLPVYDQIRNIRQIHLNTMIRIGGVVTRRSGVFPQLQQVKYDCNKCGAVLGPFFQNSYSEVKVGSCPECQSKGPFTVNIEQTVYRNYQKLTLQESPGIVPAGRLPRYKEVILLNDLIDCARPGEEIEVTGIYTNNFDLSLNTKNGFPVFATVVEANYVTKKQDLFSAYKLTQEDKEEIEKLAKDPRIGERIVKSIAPSIYGHEDIKTAIALAMFGGQEKNVEGKHRLRGDINVLLLGDPGTAKSQFLKYVEKTGQRAVYTTGKGASAVGLTAAVHKDPVTREWTLEGGALVLADKGICLIDEFDKMNDQDRVSIHEAMEQQSISISKAGIVTSLQARCSVIAAANPIGGRYDSSKTFSQNVELTDPIVSRFDILCVVKDIVDPVTDEMLAKFVVDSHFKSQPKGANMDDRSVSESHEDNQATARPVDTEILPQDLLKKYLTYAKLNVFPRLHDADLDKLTHVYAELRRESSHGQGVPIAVRHIESMIRMSEAHARMHLRQHVTQEDVDMAIRVLLDSFISTQKFGVQKALQKSFRKYMTFKKDYNELLLYLLRELVKNALHFEEIVSGSTSRLTQIDVKVEDLQSKAQEHEIYDLKPFFTSPHFSRADFVLDEQRGVIRHRLARI

SEQ ID NO: 3754 - protein, 865 aa, Aquilegia formosa
MEEHDQYESVGLDDSMEDERDLDQIMADRRAAEVELDTKEGRNSNRKLPRLLHDQDTDEDINYRRPKRSRADFRPPADARSYDDADAMQSSPGRSQRGHSRDDVPMTDQTDDEPYEDDDDDEGEFEMYRVQGTLREWVTRDEVRRFIAKKFKEFLLTYVNPKNEQGEFEYIRLINEMMRVNKCSLEIDYKQFIYIHPNIAIWLADAPQSVLEVMEEVAKNVVFNLHPNYKEIHQKIYVRITNLPVYDQIRNIRQIHLNTMIRIGGVVTRRTGVFPQLQQVKYDCNKCGTILGPFFQNSYSEVKVGSCPECQSKGPFTVNIEQTIYRNYQKLTLQESPGIVPAGRLPRYKEVILLNDLIDCARPGEEIEVTGIYTNNFDLSLNTKNGFPVFATVVEANYVTKKKDLFSAYKLTVEDTNEIENLGRDPRIGERIIKSIAPSIYGHEDIKTALALAMFGGQEKNVQGKHRLRGDINVLLLGDPGTAKSQFLKYVEKTGQRAVYTTGKGASAVGLTAAVHKDPVTREWTLEGGALVLADRGICLIDEFDKMNDQDRVSIHEAMEQQSISISKAGIVTSLQARCSVIAAANPIGGRYDSSKNFSQNVELTDPIVSRFDVLCVVKDVVDPVVDEMLASFVVNSHFKSQPKGANLDDTSMNNSQEEDPSSTRLVDPEILSQDMLKKYITYAKLNIQPRLNEADLNKLTHVYAELRRESSHGQGVPIAVRHIESMIRMSEAHARMHLRKDVAQEDVDMAIRVLLDSFISTQKFGVQKALQKSFRKYMTFKKEFNDLLLYLLRGLVRDAMHFEELVNGSAAGLTHIDVKVKDLENKAQEYEIYDLKPFFTSTLFSGANFDLDEERGIIKHRLAG

SEQ ID NO: 3755 - protein, 262 aa, Triticum aestivum
MAKAFYAVGFWIRETGQALDRLGCRLQGNYFFHEQISRHRTLMNIFDKAPHVHKEAFVAPSASLIGDVEVGQGSSIWYGCVLRGDANNVQVGSGTNIQDNSVVHVAKSNLSGKVFPTIIGDNVTVGHSAVLQGCTVEDEAFVGMGATLLDGVVVEKHGMVAAGALVRQNTRIPCGEVWGGNPAKFLRKLTDEEIAFIAESAANYSNLAKAHAVENAKPLEKIDFEKVLRKKFAHQDDEHDSMLSVTREVPPELAPPSPTPAQ

SEQ ID NO: 3756 - protein, 262 aa, Triticum aestivum
MAKAFYAVGFWIRETGQALDRLGCRLQGNYFFHEQISRHRTLMNIFDKAPHVHKEAFVAPSASLIGDVEVGQGSSIWYGCVLRGDANNVQVGSGTNIQDNSVVHVAKSNLTGKVFPTIIGDNVTVGHSAVLQGCTVEDEAFVGMGATLLDGVVVEKHGMVAAGALVRQNTRIPCGEVWGGNPAKFLRKLTDEEIAFIAESAANYSNLAKAHAVENAKPLEKIDFEKVLRKKVAHQDEEHDSMLSGTREVPPELAPPSPTPAQ

SEQ ID NO: 3757 - protein, 262 aa, Leymus cinereus x Leymus triticoides
  misc_feature (162)..(162): Xaa can be any naturally occurring amino acid
MAKAFYAVGFWIRETGQALDRLGCRLQGNYFFHEQISRHRTLMNIFDKAPHVHKEAFVAPSASLIGDVEVGQGSSIWYGCVLRGDANNVQVGSGTNIQDNSVVHVAKSNLSGKVFPTIIGDNVTVGHSAVLQGCTVEDEAFVGMGATLLDGVVVEKHGMVAXGALVRQNTRIPRGEVWGGNPAKFLRKLTDEEIAFIAESAANYSNLAKAHAVENAKPLEKIDFEKVLRKKFAHQDEEHDSMLSVTREVPPELAPPSPTPVQ

SEQ ID NO: 3758 - protein, 262 aa, Secale cereale
MAKAFYAVGFWIRETGQALDRLGCRLQGNYFFHEQISRHRTLMNIIDKAPHVHKEAFVAPSASLIGDVEVGQGSSIWYGCVLRGDANNVQVGSGTNIQDNSVVHVAKSNLSGKVFPTIIGDNVTVGHSAVLQGCTVEDEAFVGMGATLLDGVVVEKHGMVAAGALVRQNTRIPCGEVWGGNPAKFLRKLTDEEIAFIAESAANYSNLAKAHAVENAKPLEKIDFEKVLRKEVAHQDEEHGSMLSGTREVPPELAPPSPTPAQ

SEQ ID NO: 3759 - protein, 262 aa, Secale cereale
MAKAFYAVGFWIRETGQALDRLGCRLQGNYFFHEQLSRHRTLMNIFDKAPHVHKEAFVAPSASLIGDVEVGQGSSIWYGCVLRGDANNVQVGSGTNIQDNSVVHVAKSNLSGKVFPTIIGDNVTVGHSAVLQGCTVEDEAFVGMGATLLDGVVVEKHGMIAAGALVRQNTRIPCGEVWGGNPAKFLRKLTDEEIAFIAESAANYSNLAKAHAVENAKPLEKIDFEEVLHKKFAHQDEDHDSMLSVTREVPPELAPPSPTPAQ

SEQ ID NO: 3760 - protein, 305 aa, Secale cereale
SQSLPPRDLSQGQGQEPTNARPPPPLRLRSRRSAILPAAALRDGEGVLRGGFLDPGDRSGPRPPRLSPPGELLLPRAAFKAPHGLMNIFDKAPHVHKEAFVAPSASLIGDVEVGQGSSIWYGCVLRGDANNVQVGSGTNIQDNSVVHVAKSNLSGKVFPTIIGDNVTVGHSAVLQGCTVEDEAFVGMGATLLDGVVVEKHGMIAAGALVRQNTRIPCGEVWGGNPAKFLRKLTDEEIAFIAESAANYSNLAKAHAVENAKPLEKIDFEEVLHKKFAHQDEDHDSMLSVTREVPPELAPPSPTPAQ

SEQ ID NO: 3761 - protein, 109 aa, Secale cereale
MAKAFYAVGFWIRETGQALDRLGCRLQGNYFFHEQISRHRTLMNIIDKAPHVHKEAFVAPSASLIGDVEVGQGSSIWYGCVLRGDANTFKLDLGRIYRTILLCMWQNLI

SEQ ID NO: 3762 - protein, 259 aa, Pseudoroegneria spicata
  misc_feature (3)..(4): Xaa can be any naturally occurring amino acid
AFXXVGFWIRETGQALDRLGCRLQGNYFFHEQISRHRTLMNIFDKAPHVHKEAFVAPSASLIGDVEIGQGSSIWYGCVLRGDANNVQVGSGTNIQDNSVVHVAKSNLSGKVFPTIIGDNVTVGHSAVLQGCTVEDEAFVGMGATLLDGVVVEKHGMVAAGALVRQNTRIPCGEVWGGNPAKFLRKLTDEEITFIAESAANYSNLAKAHAVENAKPLEKIDFEKVLRKKFAHQDEEHDSMLSVTREVPPELAPPSPTPAQ

SEQ ID NO: 3763 - protein, 262 aa, Triticum aestivum
MAKAFYAVGFWIRETGQALDRLGCRLQGNYFFHEQISGHRTLMNIFDKAPHVHKEAFVAPSASLIGDVEVGQGSSIWYGCVLRGDANNVQVGSGTNIQDNSVVHVAKSNLTGKVFPTIIGDNVTVGHSAVLQGCTVEDEAFVGMGATLLDGVVVEKHGMVAAGALVRQNTRIPCGEVWGGNPAKFLRKLTDEEIAFIAESAANYSNLAKAHAVENAKPLEKIDFEKVLRKKFTHHDEEHDSMLSGTREVPPELAPPSPTPAQ

SEQ ID NO: 3764 - protein, 263 aa, Hordeum vulgare
MAKASYAVGFWIRETGQALDRLGCRLQGNYFFHEQISRHRTLMNIFDKAPHVHKEAFVAPSASLIGDVEVGKGSSIWYGCVLRGDANNVRVGSGTNIQDNSVVHVAKSNLSGKVFPTIIGDNVTVGHSAVLQGCTVEDEAFVGMGATLLDGVVVEKHGMVAAGALVRQNTRIPCGEVWGGNPAKFLRKLTDEEIAFIAESAANYSNLAKAHAVENAKPVEKIDFEKVLRKKVAHQDEEHGSMLGATREVPPELAPPSPTPAAQ

SEQ ID NO: 3765 - protein, 257 aa, Secale cereale
YAVGFWIRETGQALDRLGCRLQGNYFFHEQISRHRTLMNIIDKAPHVHKEAFVAPSASLIGDVEVGQGSSIWYGCVLRGDANNVQVGSGTNIQDNSVVHVAKSNLSGKVFPTIIGDNVTVGHSAVLQGCTVEDEAFIGMGATLLDGVVVEKHGMVAAGALVRQNTRIPCGEVWGGNPAKFLRKLTDEEIAFIAESAANYSNLAKAHAVENAKPLEKIDFEKVLRKEVAHQDEEHGSMLSGTREVPPELAPSSPTPAQ

SEQ ID NO: 3766 - protein, 213 aa, Secale cereale
MAKAFYAVGFWIRETGQALDRLGCRLQGNYFFHEQISRHRTLMNIIDKAPHVHKEAFVAPSASLIGDVEVGQGSSIWYGCVLRGDANNVQVGSGTNIQDNSVVHVAKSNLSGKVFPTIIGDNVTVGHSAVLQGCTVEDEAFVGMGATLLDGVVVEKHGMVAAGALVRQNTRIPCGEVWGGNPAKFLRKLTDEEIAFIAESAANYSNLAKAHAC

SEQ ID NO: 3767 - protein, 260 aa, Brachypodium distachyon
MAKAFYAVGFWIRETGQALDRLGSRLQGNYFFHEQISRHRTLMNIFDKAPYVHREAFVAPSASLIGDVQVGQGSSIWYGCVLRGDANNVQIGSGTNIQDNSVVHVAKSNLSGKVFPTIIGDNVTVGHSAVLQGCTVEDEAFVGMGATLLDGVVVEKHGMVAAGALVRQNTRIPCGEVWGGNPAKFLRKLTDEEIAFIAESAANYSNLAKAHAVENAKPLEKIEFEKVLRKRFARQDEEYDSMLGVTREAHPELTPPSPAQ

SEQ ID NO: 3768 - protein, 262 aa, Lolium multiflorum
MAKAFYAVGFWIRETGQALDRLGCRLQGNYFFHEQISRHRTLMNIVDKGPHVHREAFVAPSASLTGDVQVGQGSSIWYGCVLRGDANNVQIGSGTNIQDNSVVHVAKSNLSGKVFPTIIGDNVTVRHSAVLQGCTVEDEAFVGMGATLLDGVVVEKHGMVAAGALVRQNTRIPCGEVWGGNPAKFLRKLTDEEIAFIAESAAKYSTLAKEHAAENAKPLESIEFMKVLRKKFAHQDEEDDSMLGVTREASPELAPSSATPAQ

SEQ ID NO: 3769 - protein, 262 aa, Avena sativa
MAKAFYAVGFWIRETGQALDRLGSRLQGNYFFHEQISRHRTLMNIVDKTPYVHKEAFVAPSASLIGDVQVGQGSSIWYGCVLRGDANNVQIGSRTNIQDNSVVHVAKSNLSGKVFPTIIGNNVTVGHSAVLQGCTVEDEAFVGMGATLLDGVVVEKHGMVAAGALVRQNTRIPCGEVWGGNPAKFLRKLTDEEIAFISESAATYSTLAKEHAAENDKPLEQIDFEKVLRKKSAHEDDEHDSMLGVTREVPPELAPSSASPAQ

SEQ ID NO: 3770 - protein, 263 aa, Saccharum officinarum
MAGLGKAMYAVGFWIRETGQALDRLGCRLQGKYFFHEQISRHRTIMNIFDKTPHVHKDAFVAPSASLIGDVQVGPGASIWYGCVLRGDANNIQIGSGTNIQDNSLVHVAKSNLSGKVFPTIIGNNVTVGHSAVLQGCTVEDEAFVGMGATLLDGVVVEKHGMVAAGALVRQNTRIPCGEVWGGNPAKFLRKLTDDEIAFIAESAANYSSLSKAHADENAKPLEKIEFEKVLRKKFAHQDEEYDSSIGVTREAPPELTSPNPAQ

SEQ ID NO: 3771 - protein, 263 aa, Sorghum bicolor
MAGLGKAMYAVGFWIRETGQALDRLGCRLQGKYFFHEQISRHRTIMNIFDKTPHVHKDAFVAPSASLIGDVQVGPGASIWYGCVLRGDANNIQIGSGTNIQDNSLVHVAKSNLSGKVFPTIIGNNVTVGHSAVLQGCTVEDEAFVGMGATLLDGVVVEKHGMVAAGALVRQNTRIPCGEVWGGNPAKFLRKLTDDEIAFIAESAANYSSLSKVHAIENAKPLEKIEFEKVLRKKFAHQDEEYDSSIGVTREAPPELTSPNPAQ

SEQ ID NO: 3772 - protein, 241 aa, Hordeum vulgare
GCRLQGNYFFHEQISRHRTLMNIFDKAPHVHKEAFVAPSASLIGDVEVGKGSSIWYGCVLRGDANNVRVGSGTNIQDNSVVHVAKSNLSGKVFPTIIGDNVTVGHSAVLQGCTVEDEAFVGMGATLLDGVVVEKHGMVAAGALVRQNTRIPCGEVWGGNPAKFLRKLTDEEIAFIAESAANYSNLAKAHAVENAKPVEKIDFEKVLRKKVAHQDEEHGSMLGATREVPPELAPPSPTPAAQ

SEQ ID NO: 3773 - protein, 263 aa, Setaria italica
MAGLGKAMYAVGFWIRETGQALDRLGCRLQGNYFFHEQISRHRTLMNIFDKTPHVHRDAFVAPSASLIGDVQVGPGASIWYGCVLRGDANNIQIGSGTNIQDNSLVHVAKSNLSGKVFPTIIGENVTVGHSAVLQGCTIEDEAFVGMGATLLDGVIVEKHGMVAAGALVRQNTRIPSGEVWGGNPAKFLRKLTDDEIAFIAESAANYFSLSKEHAAENAKPLEKVEFEKVLPKKFAHQDEEYDSTIGVTREAPPELTPPTPAQ

SEQ ID NO: 3774 - protein, 263 aa, Pennisetum glaucum
MAGLGKAMYAVGFWIRETGQALDRLGCRLQGNYFFHEQISRHRTLMNVFDKTPHVHRDAFVAPSASLIGDIQVGPGASIWYGCVLRGDANNIQIGSGTNIQDNSLVHVAKSNLSGKVFPTIIGENVTVGHSAVLQGCTVEDEAFVGMGATLLDGVIVEKHGMVAARALVRQNTRIPSGEVWGGNPAKFLRKLTDEEIAFIAESAANYLSLSKAHAAENAKPLEKVEFEKVLRKKLAHQDEEYDSRIGVTREAPPELTPPTPAQ

SEQ ID NO: 3775 - protein, 263 aa, Panicum virgatum
MAGLGKAMYAVGFWIRETGQALDRLGCRLQGKYFFHEQISRHRTLMNIFDKTPHVHRDAFVAPSASLIGDVQVGPGASIWYGCVLRGDANNIQIGSGTNIQDNSLVHVAKSNLSGKVFPTIIGEKVTVGHSAVLQGCTIEDEAFVGMGATLLDGVVVEKHGMVAAGALVRQNTRIPSGEVWGGNPAKFLRKLTADEIAFIAESAANYCSLSQAHAVENAKPLEKVEFEKVLRKKFANQDEEYDSTIGVTQEAPPELTPSTPAQ

SEQ ID NO: 3776 - protein, 263 aa, Oryza sativa
MAGLGKAFYAVGFWIRETGQALDRLGCRLQGNYYFHEQLSRHRTLMNIFDKTPHVHRDAFVAPSASLIGDIQVGQGASIWYGCVLRGDANNVQIGSGTNIQDNSLVHVAKSNLSGKVFPTIIGDNVTVGHSAVLQGCTVEDEAFVGMGATLLDGVVVEKHGMVAAGALVRQNTRIPCGEVWGGNPAKFLRKLTDDEITFIKESASNYSTLAKAHAAENAKPVEKTEFEKLFRKKSAHQDEEHDSMIGATREVTPELTPSSSAQ

SEQ ID NO: 3777 - protein, 263 aa, Panicum virgatum
MAGLGKAMYAVGFWIRETGQALDRLGCRLQGKYFFHEQISRHRTLMNIFDKTPHVHRDAFVAPSASLIGDVQVGPGASIWYGCVLRGDANNIQIGSGTNIQDNSLVHVAKSNLSGKVFPTIIGENVTVGHSAVLQGCTIEDEAFVGMGATLLDGVVVEKHGMVAAGALVRQNTRIPSGEVWGGNPAKFLRKLTADEIAFIAESAANYYSLSKAHAFENAKPLEKVEFEKVLRKKFANQDEEYDSTIGVTQEAPPQLTPSTPAQ

SEQ ID NO: 3778 - protein, 262 aa, Zea mays
MAGLGKAMYAVGFWIRETGQALDRLGCRLQGKYFFHEQISRHRTIMNIFDKTPHVHKDAFVAPSASLIGDVQVGSGASIWYGCVLRGDANIIQIGSGTNIQDNSLIHVAKSNLSGKVFPTTIGNNVTVGHSAVLQGCTVEDEAFVGIGATLLDGVVVEKHGMVAAGALVRQNTRIPCGEVWGGNPAKFLRKLTDDEISFIAESAANYSNLSKVHAAENAKPLEKIEFEKVLGKKFAHQDEYDSSIGVAEGAPPELTSPNPAQ

SEQ ID NO: 3779 - protein, 263 aa, Zea mays
MAGLGKAMYAVGFWIRETGQALDRLGCRLQGKYFFHEQISRHRTIMNIFDKTPHVHRDAFVAPSASLIGDVQVGQGASIWYGCVLRGDANNIQIGSGTNIQDNSLVHVAKSNLSGKVFPTIIGNNVTIGHSAVLQGCTVEDEAFVGMGATLLDGVVVEKHGMVAAGSLVRQNTRIPCGEVWGGNPAKFLRKLTDDEIAFITESASNYSNLSKVHAAENAKPLEKIEFEKVLRKKFAHQDEEYDSSIGITRGSPPELTSPNPAQ

SEQ ID NO: 3780 - protein, 369 aa, Triticum aestivum
MSGLVLLLLCATCRLALGITDGLLANGNFERGPQPSQLRGTQVVGASSIPSWRTSGFVEYIPSGRKQGDMVLVVPEGAYAVRLGNEASIAQRLRGAVPGARYSLTFSAARTCAQAERLNVSASGQSGVLVMQTMYSSNGWDSYSWAWDATADEVEVVVHNPGVTEDPACGPLIDSVAIKTLTPPRRTNKNLVKNGDFEEGPYIIPGTKWGVLIPSRMVDEHSPLPGWMVESLKAVKYIDSDHFAVPRGRRAVELLAGRESAIAQVIRTVPGKQYALSFSVGNASNTCRGSLMVEAYAGRESTKVPYESAGQGGAAKRAVLPFRATSSRTRVVFFSSFYNTMTDDMSSLCGPVIDDVAVVSVRARPPKRP

SEQ ID NO: 3781 - protein, 369 aa, Secale cereale
MSGLVLLLLCATCRLALGITDGLLANGNFERGPQLSQLRGTQVVGASSIPSWRTSGFVEYIPSGRKQGDMVLVVPEGAYAVRLGNEASIAQRLRGAVPGAFYSLTFSAARTCAQAERLNVSASGQSGVLVMQTMYSSNGWDSYSWAWDATADEVEVVIHNPGVTEDPACGPLIDSVAIKTLTPPRRTNKNLVKNGDFEEGPYIIPGTKWGVLIPSRMVDEHSPLPGWMVESLKAVKYIDSDHFAVPRGRRAVELLAGRESAIAQVIRTVPGKQYALSFSVGDASNTCRGSLMVEAYAGRESTKVPYESAGQGGAAKRAVLPFRATSSRTRVVFLSSFYNTRTDDMSSLCGPVIDDVAVVSVRARPPKRA

SEQ ID NO: 3782 - protein, 153 aa, Hordeum vulgare
MSEPRHVLLASPTLKDSAYCFPGTVRITCAMALSLPASSSTARRPRGTAKWSLSMYLTALSDSTIHPGSGECSSTVRDGISTPHFVPGMMYGPSSKSPFFTRLHECSLLVRRGGVRVLMATESMRGPQAGSSVTPGLWTTTSTSSALASQAQE

SEQ ID NO: 3783 - protein, 197 aa, Sorghum bicolor
MGRLSMAVPVMLLLLCATCRLALGITDGLLPNGNFERGPAPSQLRGTRVMGSSAIPAWQTSGFVEYIPSGRKQGDMVLVVPEGAYAVRLGNEASIRQRLHGAARGARYSLTFSAARTCAQAEQLNVSASGQSGLLAMQTMYSSNGWDSYAWAWVADADEVDVVIHNPGVPRTPPAARSSTPSRSRRSTRLAGPTRTW

SEQ ID NO: 3784 - protein, 379 aa, Oryza sativa
MAAGSASLLLLMVVLCAAASGTALAAITDGLLANGNFERGPAPSQLRGTRVVGASAIPSWRTSGFVEYIPSGRKQGDMVLVVPEGSHAVRLGNEASIRQRLAGAARGARYALTFSAARTCAQAERLNVSASGQWAVLPMQTMYSSNGWDSYAWAWDAAADAFDVVIHNPGVTEDPACGPLIDSVAIRTLNPPRRTNKNLVKNGDFEEGPYIIPGTRWGVLIPSMVVDEHSPLPGWMVESLKAVKYIDSDHFAVPRGRRAVELLAGRESAIAQVIRTVPGRQYALSFTVGDASNGCEGSLVVEAYAGRESTRVAHESAGRGGAAKRAVLPFRAAAARTRVVFFSSFYSTRSDDMSSLCGPVIDDVAVVSVRARRPAAKRG

SEQ ID NO: 3785 - protein, 371 aa, Zea mays
MGRLALAVPVMLLLLCTTCRLTLGITDGLLPNGNFERSPLPSQLRGTRVVGASAIPSWQTSGFVEYISSGQKQGDMVLVVPEGAYAVRLGNEASIRQRLRGAARGARYSLTFSAARTCAQAEQLNVSASGQSGLLAMQTMYSSNGWDSYAWAWVANADEVDIVIHNPGVTEDPACGPLIDSVAIKTLNPPRRTNKNLVKNGDFEEGPYIIPGTKWGVLIPSRVVEDHSPLPGWMVESLKAIKYIDGESFAVPRGRRAVELLAGRESAIAQVIRTVPGRQYVLSFTIGDASNACRGSLMVEAYAGRESTKVAYESAGKGGVKRAVLPFRAASARTRLVFFSSFYSTRSDDLSSLCGPVLDDVVVVSVRTKRG

SEQ ID NO: 3786 - protein, 366 aa, Panicum virgatum
MAGPAMLLLLCTVCRLALGITDGLLPNGNFERGPVPSQLRGTRVLGSSAIPSWQTSGFVEYIPSGKKQGDMLLVVPEGAYAVRLGNEASIRQRLRGAARGARYSLTFSAARTCAQAEQLNVSASGQSGLLAMQTMYSSNGWDSYAWAWVADAGEVDVVIHNPGVTEDPACGPLIDSVAIKTLNPPRRTNRNLVKNGDFEEGPYIIPGTRWGVLIPSRVVDDHSPLPGWMVESLKAVKYIDGGSFAVPRGRRAVELLAGRESAVAQVIRTVPGRRYALSFTVGDAGNACRGSLMVEAYAGRESTKVAYESAGKGGVKRAVLPFRAASARTRIVFFSSFYSTRSDDLSSLCGPVLDDVAVVSVRAKRG

SEQ ID NO: 3787 - protein, 369 aa, Setaria italica
MAGPVILLLLCTMCRLALGITDGLLPNGNFERGPLPSQLRGTRVLGSSSIPSWQTSGFVEYIPSGQKQGDMLLVVPEGAYAVRLGNEASIRQRLRGAAPGARYSLTFSAARTCAQAERLNISASGQSGLLAIQTTYSSNGWDSYAWAWVAAVDSSGEVEVSIHNPGVADDPACGPLIDSVAVKALNPPRRTNRNLVKNGDFEEGPYILPGTKWGVLIPSRVVDDHSPLPGWMVESLKAVRYVDGGSFAVPRGRRAVELLAGREGAVAQVVRTVPGRRYALSFTVGDAGNACRGSLVVEAYAGRESVKVAYESEGKGGARRAVLPFRAAAARTRIVFFSSFYSTRSDDLSSLCGPVLDDVAVVSVRAKRG

SEQ ID NO: 3788 - protein, 430 aa, Leymus cinereus x Leymus triticoides
  misc_feature (252)..(252): Xaa can be any naturally occurring amino acid
MAATTVPLLLLLAATVAAATDLSVYHNVHPPSASPLESIISLARDDDARLLFLSSKAASTGVTSAPVASGQTPPSYVVRAGLGSPAQPILLALDTSADATWAHCSPCGTCPTNCLFVPANSSSYAPLPCSSSMCSILQGQPCPDRDPFDSAVPLPSCAFSKPFADASFQAALASDWLHLGKDSIPNYAFGCVGSVSGPTSNLPKQGLLGLGRGPMALLSQVGNMYSGVFSYCLPSYKSYYFSGSLRLGTAGXPRAARYTPMLKNPHRSSLYYVNVTGLSVGRSPVKVPAGSFAFDPNTGAGTVVDSGTVITRWTAPVYAALREEFRRHVAAPSGYTSLGAFDTCFNTDEVAAGGAPAVTIHMDGGVDLALPMENTLIHSSATPLACLAMAEAPQNVNSVVNVVANLQQQNLRVVFDVANSRVGFARESCN

SEQ ID NO: 3789 - protein, 430 aa, Triticum aestivum
MAPTRLPLLLLLAATVAAAADLSVYHNVHPPSASPLESIIALARDDDARLLFLSSKAASTGTASAPVASGQTPPSYVVRAGLGSPAQPMLLALDTSADATWAHCSPCGTCPASSLFVPANSSSYAPLPCSSSMCPILQGQPCPDRDPFDSAAPLPSCAFSKPFADASFQAALASDWLHLGKDSIPNYAFGCVGSVSGPTSNLPKQGLLGLGRGPMALLSQVGNMYNGVFSYCLPSYKSYYFSGSLRLGAAGQPRAARYTPMLRNPHRSSLYYVNVTGLSVGRSPVKVPAGSFAFDPSTGAGTVVDSGTVITRWTAPVYAALREEFRRHVAAPSGYTSLGAFDTCFNTDEVAAGGAPAVTIHMDGGVDLALPMENTLIHSSATPLACLAMAEAPQNVNSVVNVVANLQQQNLRVVFDVANSRVGFARESCN

SEQ ID NO: 3790 - protein, 431 aa, Triticum aestivum
MAATRLPLLLLLLAATVAAAADLSVYHNVHPQSASPLESIIALARDDDARLLFLSSKAASAGAASAPVASGQTPPSYVVRAGLGSPAQPMLLALDTSADATWAHCSPCGTCPASSLFVPANSSSYAPLPCSSSMCPILQGQPCPDRDPFDSAAPLPSCAFSKPFADASFQAALASDWLHLGKDSIPNYAFGCVGSVSGPTSNLPKQGLLGLGRGPMALLSQVGNMYNGVFSYCLPSYKSYYFSGSLRLGAAGQPRAARYTPMLRNPHRSSLYYVNVTGLSVGRSPVKVPAGSFAFDPSTGAGTVVDSGTVITRWTAPVYAALREEFRRHVAAPSGYTSLGAFDTCFNTDEVAAGGAPAVTIHMDGGVDLALPMENTLIHSSATPLACLAMAEAPQNVNSVVNVVANLQQQNLRVVFDVANSRVGFARESCN

SEQ ID NO: 3791 - protein, 409 aa, Secale cereale
VSVYHNRPPSVRSPLESIISLARDDDARLLFLSSKAASAGAASAPVASGQTPPSYVVRAGLGSPAQPILLALDTSADATWAHCSPCGTCPTSSLFVPANSSSYAPLPCSSSMCPILQGQPCPDRDPFDSAAPLPSCSFSKPFADASFQAALASDWLHLGKDSIPNYAFGCVGAVSGPTSNLPKQGLLGLGRGPMALLSQVGNLYSGVFSYCLPSYKSYYFSGSLRLGAAGQPRGARYTPMLRNPHRSSLYYVNVTGLSVGRSPVKVPAGSFAFDPSTGAGTVVDSGTVITRWTAPVYAALREEFRRHVAAPSGYTSLGAFDTCFNTDEVAAGRAPAVTVHMDGGVDLALPMENTLIHSSATPLACLAMAEAPQNVNSVVNVLANLQQQNLRVVFDVANSRVGFARESCN

SEQ ID NO: 3792 - protein, 432 aa, Brachypodium distachyon
MAATRIPLILLLAIATIAAAADLSVYHNVHPPSSSPLESIIALAREDDARLLFLSSKAASTGVSSAPVASGQSPPSYVVRAGLGSPAQPILLALDTSADATWAHCSPCGTCPSSGSLFAPANSTSYAPLPCSSTMCTVLQGQPCPAQDPYDSSAPLPMCAFTKPFADASFQASLASDWLHLGKDAIPNYAFGCVSAVSGPTANLPKQGLLGLGRGPMALLSQVGNMYNGVFSYCLPSYKSYYFSGSLRLGAAGQPRGVRYTPMLKNPNRSSLYYVNVTGLSVGRAPVKVPAGSFAFDPATGAGTVVDSGTVITRWTPPVYAALREEFRRHVAAPSGYTSLGAFDTCFNTDEVAAGVAPAVTVHMDGGLDLALPMENTLIHSSATPLACLAMAEAPQNVNAVVNVLANLQQQNLRVVFDVANSRVGFARESCN

SEQ ID NO: 3793 - protein, 139 aa, Oryza sativa
MFCCCRLAMTLTTELTFCGASAMARQASGVALLWMSVFSIGSARSTPPSMCTVTAGAPPAATSSVLKHVSNAPSDVYPLGAATCRRNSSRSAAYTGAVHRVITVPESTTVPAPVAASNANDPAGTFTHACPTLSPVTFT

SEQ ID NO: 3794 - protein, 438 aa, Oryza sativa
MAATTTIPLLLLLLAATVAAAAAELSVYHNVHPSSPSPLESIIALARDDDARLLFLSSKAATAGVSSAPVASGQAPPSYVVRAGLGSPSQQLLLALDTSADATWAHCSPCGTCPSSSLFAPANSSSYASLPCSSSWCPLFQGQACPAPQGGGDAAPPPATLPTCAFSKPFADASFQAALASDTLRLGKDAIPNYTFGCVSSVTGPTTNMPRQGLLGLGRGPMALLSQAGSLYNGVFSYCLPSYRSYYFSGSLRLGAGGGQPRSVRYTPMLRNPHRSSLYYVNVTGLSVGHAWVKVPAGSFAFDAATGAGTVVDSGTVITRWTAPVYAALREEFRRQVAAPSGYTSLGAFDTCFNTDEVAAGGAPAVTVHMDGGVDLALPMENTLIHSSATPLACLAMAEAPQNVNSVVNVIANLQQQNIRVVFDVANSRVGFAKESCN

SEQ ID NO: 3795 - protein, 428 aa, Setaria italica
MAATTLLVLLLAATAASAADLSVYHNVHPPSPSPLESIIALARADDARLLFLSSKAAASPGVTSAPVASGQAPPSYVVRAGLGTPVQQTLLALDTSADATWAHCAPCDTCPAGSRFIPASSSSYAALPCASDWCPLFQGQPCPANQDAGASMPTCAFSKPFADASFQASLGSDTLRLGKDAIANYAFGCVGAVTGPTTNLPKQGLLGLGRGPMSLLSQTGSRYNGVFSYCLPSYKSYYFSGSLRLGAAGQPRNARYTPLLSNPHRPSLYYVNVTGLSVGRAWVKVPAGAFAFDPATGAGTVIDSGTVITRWTAPVYAALREEFRRQVGAPSGYTSLGAFDTCFNTDEVAAGGAPAVTLHMDGGVDLTLPMENTLIHSSATPLACLAMAEAPQNVNSVVNVVANLQQQNVRVVVDVAASRVGFAREPCN

SEQ ID NO: 3796 - protein, 429 aa, Panicum virgatum
MAATTILLLLVLAATAASAADLSVYHNVHPPSPSPLESIIALARADDARLLFLSSKAAASPGVTSAPVASGQAPPSYVVRAGLGTPVQQTLLALDTSADATWAHCAPCDTCPAGSRFIPASSSSYAALPCTSDWCPLFQGQPCPANQAASLALPACAFSKPFADASFQASLGSDTLRLGKDAIANFAFGCVGAVTGPTTNLPKQGLLGLGRGPMSLLSQTGSRYNGVFSYCLPSYKSYYFSGSLRLGAAGQPRNVRYTPLLSNPHRPSLYYVNVTGLSVGRTWVKVPAGAFAFDANTGAGTVIDSGTVITRWTAPVYAALREEFRRQVGAPSGYTSLGAFDTCFNTDEVAAGGAPAVTLHMDGGVDLTLPMENTLIHSSATPLACLAMAEAPQNVNSVVNVVANLQQQNVRVVVDVAGSRVGFAREPCN

SEQ ID NO: 3797 - protein, 431 aa, Zea mays
MATTTTTILLLLLVAATAVSAADLSVYHNVHPPSPSPLESIIALARADDARLLFLSSKAASSGGVTSAPVASGQTPPSYVVRAGLGTPVQQLLLALDTSADATWSHCAPCDTCPAGSRFIPASSSSYASLPCASDWCPLFEGQPCPANQDASAPLPACAFSKPFADTSFQASLGSDTLRLGKDAIAGYAFGCVGAVAGPTTNLPKQGLLGLGRGPMSLLSQTGSRYNGVFSYCLPSYRSYYFSGSLRLGAAGQPRNVRYTPLLTNPHRPSLYYVNVTGLSVGRTWVKVPAGSFAFDPATGAGTVIDSGTVITRWTAPVYAALREEFRRQVAAPSGYTSLGAFDTCFNTDEVAAGGAPPVTLHMDGGVDLTLPMENTLIHSSATPLACLAMAEAPQNVNAVVNVVANLQQQNVRVVVDVAGSRVGFAREPCN

SEQ ID NO: 3798 - protein, 429 aa, Panicum virgatum
MAATTTIFLLLLLAASSAASAADLSVYHNVHPPSPSPLESIIALARADDARLLFLSSKAAASPGVTSAPVASGQAPPSYVVRAGLGTPVQQTLLALDTSADATWAHCAPCDTCPAGSRFIPASSSSYAALPCASDWCPLFQGQPCPANQQAALPACAFSKPFADASFQASLGSDTLRLGKDAVANFAFGCVGAVTGPTANLPKQGLLGLGRGPMSLLSQTGSRYGGVFSYCLPSYKSYYFSGSLRLGAAGQPKNVRYTPLLSNPHRPSLYYVNVTGLSVGRAWVKVPAGAFAFDAGTGAGTVIDSGTVITRWTAPVYAALREEFRRQVGAPSGYTSLGAFDTCFNTDEVAAGGAPAVTLHMDGGVDLTLPMENTLIHSSATPLACLAMAEAPQNVNSVVNVVANLQQQNVRVVVDVAASRVGFAREPCN

SEQ ID NO: 3799 - protein, 490 aa, Triticum aestivum
MAPPISADVVVEAAPAPASMAVLNQMVCASAPAPIITVVSKQLVLPEGAAPVGDLKLSVSDMPMLSCHYIQKGLFFPPAGMPNARLVSSLALSLSRALGVFPALAGRLVTLPDDRIVIRCDDGAAVEFYHAVAPALSLADFLVRDADVPTRLTKDLFPMDRTVSYEGHRRPLTSFQVTVLGDGAVFVGLVANHAVVDGTSFWHFFNTWAGLCRGEPVQPPDFSRNFFGGSTAVLRFSGRDGPAVTFDASAPLRERVIHFSAASIRGLKAAANRCRKTNEDDEVNGKLVHDLKVQGGCGEISSFQSMCAHMWRAVTRARLQLAADATTTFRMAVNCRHRLRPKISPVYFGNAIQSVATTATVAELASHDLGWAAAKLHATVVAHEDGAIRQAAADWEAAPRCFPLGNPDGAALTMGSSPRFPMYDGNDFGWGRALAVRSGRANKFDGKMSAFPGQAGDGSVDVEVCLAPDTMGRLLCDDEFLQFVSHAPSP

SEQ ID NO: 3800 - protein, 451 aa, Secale cereale
TVVSKQLVLPEGAPPVGDLKLSVSDMPMLSCHYIQKGLFFPPAGMPNARLVSSLALSLSRALGVFPALAGRLVTLPDDRIVIRCDDGAVEFYHAVAPALSLADFLVRDADVPTRLTKDLFPMDRTVSYEGHRRPLTSFQVTVLGDGAVFVGLVANHAVVDGTSFWHFFNTWAGLCRGEPVQPPDFSRNFFGGSTAVLRFSGRDGPAVTFDASAPLRERVIHFSAASIRGLKAAANRCRKPNEDDEVNGKLVHDLKVQGGCGEISSFQSMCAHMWRAVTRARLQLAADATTTFRMAVNCRHRLRPKISPVYFGNAIQSVATTATVAELASHDLAWAAARLHATVVAHEDGAIRKAAADWEAAPRCFPLGNPDGAALTMGSSPRFPMYDGNDFGWGRALAVRSGRANKFDGKMSAFPGQAGDGSVDVEVCLAPDTMGRLLCDDEFLQFVSHAP

SEQ ID NO: 3801 - protein, 494 aa, Brachypodium distachyon
MAPPVSADAVVVEAAPAAAASKVAVLNQMVCTSVVPAAPIVTVVSKQTVVPEGVWAATGDLKLSVSDMPMLSCHYIQKGLFFPKPPVGMPITASLATALARALAVFPALAGRLVTLPDDRIVIRCDEGASVELYHAVAPALSLADFLVPDADVPTRLTKDLFPMDRTVSYEGHRRRLTSFQVTVLGDGAVFVGFVANHAVVDGTSFWHFFNTWAGLCRGAEAPEVQPPDFRRNFFGDSTAVLRFPGSEGPAVTFDAAAPLRERVIHFSAAAIRDMKAAANRRKTSGRAKDNAEVNGKLAHDSREISSFQSLCAHMWRAVTRARLRLSADAVTTFRMAVNCRHRLRPSISPLYFGNAIQSVATHATVSELASEDFPWAAAKLHATVVAHEDGAIRQAAADWEAAPRCFPLGNPDGAALTMGSSPRFPMYDGNDFGWGRALAVRSGRANKFDGKMSAFPGQAGDGSVDVEVCLAPDTMARLLGDEEFLQYVSRAPL

SEQ ID NO: 3802 - protein, 536 aa, Triticum aestivum
MGESLLTALSMDTATAHHPHQGPSTFLSMDTASHDEFDLFLPPPGPFQRCLHAAAAAPPDINLPLAADPSPPPPAMQTTNLHESNVDMLDVGLGCPQLYDSDSPAAAAATSAPVSTTTTVHVSHTKSSGSSAARKCVKRNDSIWGAWFFFTHYFKPVMSADKGGKTKAPTAAGNGNSATLDAFLVQHDMENMYMWVFKDRPENALGKMQLRSFMNGHSRLGEPQFPFSADKGFVRSHRMQRKHYRGLSNPQCLHGIEIVRAPNLVGVPEADMKRWFELTGRDANFSVPTEADDFESWRNLPTTEFELERPATAAPAKSTSHGHHKKVLNGSGLNLSTHASKHGSGDGMDISGVCHKRRKDSSPSAMEEDCSNSNSDKVQDMDVSHTFEPSWTNDFTGVMRHASGPVTAAKTIYEDSKGYLIIISLPFADIQKVKVTWKNTLTNGVVKISCTSVGRMPFLKRHDRTFKLTDPSPEHCPPGEFIREVPLPTRIPEDATLEAYCDESGTGLEIIVPKHRAGPEEHEVRVSLRPPSSWCQ

SEQ ID NO: 3803 - protein, 536 aa, Secale cereale
MGESLLTALSMDTATAHHPHQGPSTFLSMDTASHDDFDLFLPPPGPFQRCLHAAAAAPPDINLPLAADASPPPPAMQTTTLHESNVDMLDVGLGCPQLYDSDSPAAAAATSAPVSTTTTVHVSHTKSSGSSAARKCVKRNDSIWGAWFFFTHYFKPVMSADKGSKTKAPTAGGNGNSATLDAFLVQHDMENMYMWVFKDRPENALGKMQLRSFMNGHSRLGEPQFPFSADKGFVRSHRMQRKHYRGLSNPQCLHGIEIVRAPNLVGVPEADMKRWFELTGRDANFSVPTEADDFESWRNLPTTEFELERPATAAPAKGTSHGHHKKVLNGSGLNLSTHASKHGSGDGLDISGSCHKRRKDSSPSAMEEDCSNSNSDKVQDMDVSHTFEPSWTNDFTGVMRHASGPVTAAKTIYEDSKGYLIIISLPFADIQKVKVTWKNTLTNGVVKISCTSVGRMPFLKRHDRTFKLTDPSPEHCPPGEFIREVPLPTRIPEDATLEAYCDESGTGLEIIVPKHRAGPEEHEVRVSLRPPSSWCQ

SEQ ID NO: 3804 - protein, 536 aa, Triticum aestivum
MGESLLTALSMDTTTAHHPHQGPSTFLSMDTASHDEFDLFLPPPGPFQRCLHAAAAAPPDINLPLAADPSPPPPALQTTTLHESNVDMLDVGLGCPQLYDSDSPAAAAATSAPVSTTTTVHVSHTKSSGSSAARKCVKRNDSIWGAWFFFTHYFKPVMSADKGSKAKAPAAAGNGNSATLDAFLVQHDMENMYMWVFKDRPENALGKMQLRSFMNGHSRLGEPQFPFSADKGFVRSHRMQRKHYRGLSNPQCLHGIEIVRAPNLVGVPEADMKRWFELTGRDANFSVPTEADDFESWRNLPTTEFELERPATAAPAKSTSHGHHKKVLNGSGLNLSTHASKHGSGDGMDISAVCHKRRKDSSPSAMEEDCSNSNSDKVQDMDVSHTFEPSWTNDFTGVMRHASGPVTAAKTIYEDSKGYLIIISLPFADIQKVKVTWKNTLTNGVVKISCTSVGRMPFLKRHDRTFKLTDPSPEHCPPGEFIREVPLPTRIPEDATLEAYCDESGTGLEIIVPKHRAGPEEHEVRVSLRPPSSWCQ

SEQ ID NO: 3805 - protein, 536 aa, Brachypodium distachyon
MGESLLTALSMDTATAHHPHQGPSTFLSMDTASHDDFDLFLPPPGPFQRCLHAAAAAPPDINLPLAADPSPPPPALQTNTLHESNVDMLDVGLGCPQLYDSDSPAAAGVASAPVSTMTIVPVSHTKSSGSSAARKCVKRNDSIWGAWFFFTHYFKPVMSADKGGKSKAATAGVNGNNATLDAFLVQHDMENMYMWVFKDRPENALGKMQLRSFMNGHSRLGEPQFPFSADKGFVRSHRMQRKHYRGLSNPQCLHGIEIVRTPNLVGVPEADLKRWFELTGRDANFSIPTEAGDFESWRNLPSTEFELERPATAAPAKSTAHGHHKKLLNGSGLNLSTHASKHGSGDGLDISAVCHKRRKDSSPSAMEEDCSNSNSDKLQDMDVSHSFEPSWMNDFSGVMRHASGPVTAAKTIYEDSKGYLIIISLPFADIQKVKVTWKNTPTNGIVKISCTSVGRMPVLKRHDRTFKLADSSPEHCSPGDFIREVTLPTRIPEDATLEAYCDETGTGLEIIVPKYRVGPEEHEVHVSLRPPSSWCQ

SEQ ID NO: 3806 - protein, 539 aa, Oryza sativa
MGESLLTALSMDTTTAHHPHQGPSTFLSMDTASHDDFDLFLPPPPGPFRRCLHAAAAAPPDINLPLDADPSPPPPALQSGALHDPNVDMLDVGLGGPQLYDSDSPAATTGVSPAPAAATTTVAVSHAKGSNSSAARKCVKRNDTIWGAWFFFTHYFKPVMSADKNGKAKAPTAGGNGNNATLDAFLVQHDMENMYMWVFKERPENALGKMQLRSFMNGHSRLGEPQFPFSAEKGFVRSHRMQRKHYRGLSNPQCLHGIEIVRAPNLAGVPEADLKRWTELTGRDANFSIDAEASDYESWRNLPSTDFELERPATTAATKTSSHGHHKKLLNGSGLNLSTQPSNHSSGDGLDIPNICNKRRKDSSPTAMEEDCSNSNSDKVQDMEVSHTFEPSWMNDFTGVMRHASGPVTAAKTIYEDSKGYLIIISLPFADIQRVKVSWKNTLTNGIVKVSCTSVGRMPFLKRHDRTFKLVDPTPEHCPPGEFIREIPLPTRIPEDATLEAYCDESGTGLEIIVPKYRVGPEEHEVHVSMRPPSSWCQS

SEQ ID NO: 3807 - protein, 537 aa, Sorghum bicolor
MGESLLTALSMDTATAHHPHQGPSTFLSMDTASHDDFDLFLQPQGPFRRCLHAAAVAPPDINLPLAADPSPPPPASHDVNVDMLDVGLGGPQHYDSDSPAAAGPVTAPAAAATTMVAVSHTKGSGSSAARKCVKRNDSIWGAWFFFTHYFKPVMSADKGGKAKAAATTTTTTGGNGNSATLDAFLVQHDMENMYMWVFKERPENALGKMQLRSFMNGHSRLGEPQFPFSADKGFVRSHRMQRKHYRGLSNPQCLHGIEIVRAPNLAGVPEADLKRWMELTGRDANFSVPTEASDFESWRNLPSTDFELERPATMAPAKSSSHGHHKKLLNGSGLNLSTQPSNHSSGDGMEITATCNKRRKDSSPAAMEEDCSNSNSDKAQDMDVSHTFEPTWMNDFSGVMRHASGPVTAAKTIYEDSKGYLIIISLPFADFQKVKVSWKNTLTNGIVKVSCTSVGRMPFLKRHDRTFKLADPAPEHCPPGEFVREIPLPTRIPEDATLEAYRDETGTGLEIIVPKFRVGPEEHEVHVSMRPPSSWCQ

SEQ ID NO: 3808 - protein, 532 aa, Setaria italica
MGESLLTALSMDTATAHHPHQGPNTILSMDTASHEDFDLYLQPQGPFRRCLHAAAVVPPDINLPLAADPSPPPPALQDCNVDMLDVGLGGPQQYDSDSPAAAVPVSAPPAATTATVAVAHTKGSGSSAARKCVKRNDSIWGAWFFFTHYFKPVMSADKGGKAKSATAGGNGNSATLDAFLVQHDMENMYMWVFKERPENALGKMQLRSFMNGHSRLGEPQFPFSADKGFVRSHRMQRKHYRGLSNPQCLHGIEIVRAPNMTGVPEAHMKRWMELTGRDANFSIPTEASDFESWRNLPTTDFELERAASTAPAKSSSHGHHKKLLNGSGLNLSTQPSNHSSGDGMEITATCNKRRKDSSPVAMEEDCSNSNSDKAHDMDVSHTFEPSWINDFTGVMRHASGPVTAAKTIYEDSKGYLIIISLPFSDFQKVKVSWKNTLTNGIVKVSCTSVGRMPFLKRHDRTFKLADPSPEHCPPGEFVREIPLPTRIPEDATLEAYRDETGTGLEIIVPKFRVGPEEHEVHVSMRPPSSWCQ

SEQ ID NO: 3809 - protein, 533 aa, Zea mays
MGESLLTALSMDTATAHHPHQGPSTFLSMDTASHDDFDLFLQPQGPFRRCLHAAAVAPPDINLPLAADPSPPPLASLDANVDMLDVGLGGSQHYDSDSPAAAGPVSAPAAAATTMVAVSHTKGSGSSAARKCVKRNVSIWGAWFFFTHYFKPVMSADKAGKAKAATTTGGNGNSATLDAFLVQHDMENIYMWVFKERPENALGKMQLRSFMNGHSRLGEPQFPFSADKGFVRSHRMQRKHYRGLSNPQCLHGIEIVRAPNLAGVPEADLKRWMQLTGRDANFSVPTEASDFESWRNLPSTDFELERPATAAPAKSSSHGHHKKLLNGSGLNLSTQPSNHSSGDGMEITATCNKRRKDSSPTAMEEDCSNSNSDKAQDMDVIHTFEPSWMNDFSGVMRHASGPVTAAKTIYEDSKGYLIIVSLPFADFQKVKVSWKNTLTNGIVKVSCTSVGRMPLLKRHDRTFRLADPAPEHCPPGEFVREIPLPTRIPEDATLEAYCDETGTGLEIIVPKFRVGPEEHEVHVSMRPPSSWCQ

SEQ ID NO: 3810 - protein, 131 aa, Setaria italica
MLLGQLLLQDSKGYLIIISLPFSDFQKVKVSWKNTLTNGIVKVSCTSVGRMPFLKRHDRTFKLADPSPEHCPPGEFVREIPLPTRIPEDATLEAYRDETGTGLEIIVPKFRVGPEEHEVHVSMRPPSSWCQ

SEQ ID NO: 3811 - protein, 534 aa, Zea mays
MGESLLTALSMDTTTAHHPHQGPFTFLSMDTASHDHFDLFLPPQGPFRRCLHAAAVAPPDINLPLTADPSPPPPASHDANVDVLDAGLGGPQHYDSDSPAAAGPVLAPAAAAATVIAVSHTKGSGSSVARKCVKRNDSIWGAWFFFTHYFKPVMSTDKGGKAKAATTGGNGNSASATLDAFLVQHDMENMYMWIFKERSENALGKMQLRSFMNGHSRLGDPQFPFSADKGFVRSHRMQRKHYRGLSNPQCIHGIEIVRAPNLAGVPESDLKRWMELTGRDANFSIPAEASDFESWRNLPSTEFELERLAAVVPTKSSSHGHHKRLLNGSGLNLSTQPSNHSSGDAMEIATICNKRRKDSSPSATEEDCSNSNSDKAQDMDVSHTFEPSWMNDFTGVMRHASGPVTAAKTIYEDSKGYLIIVSLPFSDFQKVKVSWKNTLTNGIVKVSCISVGRMPLLKRHDRTFKLADPSPEHCPPGEFVREIPLPTRIPEDATLEAYRDETGTGLEIIVPKYRVGPEEHEVHVSMRPPSSWCQ

SEQ ID NO: 3812 - protein, 177 aa, Secale cereale
MDSGSDSDSAPEELTAVQGVEKHEEISKVEKDSAVRATQEEKDRRKRWAQRKTSSKPNKKKPLKVEDEDTEVDEETHAMPGTLPKSVIEMLAAREKQTFSSDSEEENVNQKVQKKKKRLKTTTTGPETILLKDVRSTEHIKKALEFLNHRKNQVPRSNAVLKNPNAMRLFNKPNFTS

SEQ ID NO: 3813 - protein, 177 aa, Triticum aestivum
MDSGSDSDSAPEELTAVQGVEKHEEISKVEKDSAVRATQEEKDRRKRWAQRKTSSKPNKKKPLKVEDKDTEVDEETHAMPGTLPKSVIEMLAAREKQTFSSDSEEENVNQKVQKKKKRLKTTTTGPETILLKDVRSTEHIKKALEFLSRRKNQVPRSNAVLKNPNAMRLFNKPNFTS

SEQ ID NO: 3814 - protein, 177 aa, Triticum aestivum
MDSGSDSDGAPEELTAVQGVEKHEEISKVEKDSAVRATQEEKDRRKRWAQRKTSSKPNKKKPLKVEDKDTEVDEETHAMPGTLPKSVIEMLAAREKQTFSSDSEEENVNQNVQKKKKRLKTATTGPETILLKDVRSTEHIKKALEFLSRRKNQVPRSNAVLKNPNAMRLFNKHNFTS

SEQ ID NO: 3815 - protein, 176 aa, Brachypodium distachyon
MDSGSESDGAPEELTAVQGVEKHEKISKVEKDSAARATQEGKDRRRRWAQRKTPSKPKKKKPLEVEDKDTKADEENKDTHAMPGTLPKSVIDMLAAREKQTFSSDTEEENVSQKVQKRKKRLKTSGPETILLKDVRCTQHVKNALDFLEHRKNKVPRSNAVLKNANKAMRLFKSNS

SEQ ID NO: 3816 - protein, 383 aa, Secale cereale
MSTKRVLCKFFMHGACLKGEYCEFSHDWSDQANNVCTFYQRGSCSYGSRCRYDHVKVSRNNPVPPLPSSSTATRNPVRPPPSSSTATHVASTSLQLLSSGRPLHTGHQTNSSNQRQQISMDKLALSESKPAWRNEVQLDSVSEDGIDWSSIQTAQNQTSMKLADMPICSFAAGGNCPYGEECAHMHGDLCAFCGKMCLHPYRPDERQEHIKLCEKNHKRLEALKRSQEIECSVCLDRVLSKPTAAERKFGLLSECDHPFCISCIRNWRGNSPTSGMDVNSALRACPICRKLSYYVIPSVLWYFSKEEKLEITENYKAKLKSIDCKYFDFGTGTCPFGTSCFYKHAYRDGRLEEVVLRHLDCDDGSTLIAKNIRLSDFLGRLHL

SEQ ID NO: 3817 - protein, 383 aa, Secale cereale
MSTKRVLCKFFMHGACLKGEYCEFSHDWSDQANNVCTFYQRGSCSYGSRCRYDHVKVSRNNPVPPLPSSSTATRNPVRPPPSSSTATHVASTSLQLLSSGRPLHTGHQTNLSNQRQQISMDKPALSESKPAWRNEVQLDSVSEDGIDWSSIQTAQNQTSMKLADMPICSFAAGGNCPYGEECAHMHGDLCAFCGKMCLHPYRPDERQEHIKLCEKNHKRLEALKRSQEIECSVCLDRVLSKPTAAERKFGLLSECDHPFCISCIRNWRGNSPTSGMDVNSALRACPICRKLSYYVIPSVLWYFSKEEKLEITENYKAKLKSIDCKYFDFGTGTCPFGTSCFYKHAYRDGRLEEVVLRHLDCDDGSTLIAKNIRLSDFLGRLHL

SEQ ID NO: 3818 - protein, 384 aa, Triticum aestivum
MSTKRVLCKFFMHGACLKGEYCEFSHDWSDQANNVCTFYQRGSCSYGNRCRYDHVKVSRNNPVPPLPSSSTATRNSPVRPPPSSSTATHVASTSPQLLSSGRPLHLGHQTNSSNQRQQISMDKLAVSESKPAWRNEVQLDSVSEDGIGWSSIQTAQNQTSMKLADMPICSFAAGGNCPYGEECPHMHGDLCAFCGKMCLHPYRPDERQEHIKLCEKNHKRLEALKRSQEIECSVCLDRVLSKPTAAERKFGLLSECDHPFCISCIRNWRGNSPTSGMDVNSALRACPICRKLSYYVIPSVLWYFSKEEKLEITENYKAKLKSIDCKYFDFGTGTCPFGTSCFYKHAYRDGRLEEVVLRHLDCDDGSTLIAKNIRLSDFLGRLHL

SEQ ID NO: 3819 - protein, 384 aa, Triticum aestivum
MSTKRVLCKFFMHGACLKGEYCEFSHDWSDQANNVCTFYQRGSCSYGNRCRYDHVKVSRNNPVPPLPSSSTATRNSPLRPPPSSSTATHVASTSPQLLSSGRPLHLGHQTNSSNQRQQISMDKLAVSESKPAWRNEVQLDSVSEDGIGWSSIQTAQNQTSMKLADMPICSFAAGGNCPYGEECPHMHGDLCAFCGKMCLHPYRPDERQEHIKLCEKNHKRLEALKRSQEIECSVCLDRVLSKPTAAERKFGLLSECDHPFCISCIRNWRGNSPTSGMDVNSALRACPICRKLSYYVIPSVLWYFSKEEKLEITENYKAKLKSIDCKYFDFGTGTCPFGTSCFYKHAYRDGRLEEVVLRHLDCDDGSTLIAKNIRLSDFLGRLHL

SEQ ID NO: 3820 - protein, 383 aa, Brachypodium distachyon
MSTKRVLCKFFVHGACLKGEYCEFSHDWRDQANNVCTFYQKGSCSYGSRCRYDHVKVSHNNPVPPPPSSSTPTRNSSLPLPPSSTVARVVSTSLQPTSAGRPVHIGHQTNPSNQRQQISMDMLAHSESKPAWRNDFQLDSVSEDGIDWSSNRTVQNQTSKKLADMPICSFAAAGNCPYEEECPSMHGDLCTTCGKMCLHPYRPDEREEHMKLCEKNHKRIEALKRSQEIECSVCLDRVLSKPTAAERKFGLLSECDHPFCISCIRNWRGNSPTSGMDVNSALRACPICRKLSYYVIPSVLWYFSKEEKMEIIDNYKSKLKSIDCKYFDFGTGTCPFGTSCFYKHAYRDGRLEEVILRHLDAEDGTTLIAKNIRLSDFLTRLHL

SEQ ID NO: 3821 - protein, 368 aa, Oryza sativa
MSTKRVLCKFFMHGACLKGEYCEFSHDWNDQPNNVCTFYQKGSCSYGSRCRYDHVKVSRNPTVAPPPSSSTTTRASSSLQPLSFGRPHHVGYQADSSNPRQQISMDVLAHSGSKPVWRNDFQHESVLEDGIDWSISPTVQNQTTLSPADLPICSFAAGGNCPYGEECPQMHGDLCTTCGKMCLHPYRPDEREEHTKLCEKNHKRLESLKRSQEIECSVCLDRVLSKPTAAERKFGLLSECDHPFCISCIRNWRNNSPTSGMDVNSALRACPICRKLSYYVIPSVLWYFSKEEKLEIIDNYKAKLKSIDCKYFDFGTGTCPFGSSCFYKHAYRDGRLEEVILRHLDADDGSTVIAKNIRLSDFLSRLHL

SEQ ID NO: 3822 - protein, 368 aa, Setaria italica
MSTNRVLCKFFMHGACLKGEYCEFSHDWKDQANNVCTFYQKGACSYGSRCRYDHVKVSRNPTVLPPPPSSSTARLASTSRQLLSSSHLPHTGHQTDSSNQRNQISVDMLAHPTSKPAWSNDFQHVVSEDEIDWSSNQTLQNQTKLKPSDLPICSFAAAGNCPYGEGCPQMHGDLCTTCGKMCLHPYRSDEREEHIKLCAKNHKRLEALKRSQEIECSVCLDRVLSKPTAAERKFGLLSECDHPFCIACIRNWRSNSPASGMDVNSALRACPICRKLSYYVIPSVLWYFSKEEKEEITESYKSKLKSIDCKYFDFGTGSCPFGTSCFYRHAYRDGRLEEVVLRHLDADDGSTVIAKNIRLSDFLSRMHL

SEQ ID NO: 3823 - protein, 369 aa, Zea mays
MSTKKVLCKFFMHGACLKGEYCEFSHDWSDQANNVCTFYQKGACSYGSRCRYDHVKVSRNPTVPPPRPTSSTSRRASTSLQLSSYNHPPHMVHQTDSSNQRHQISVDVLAHSASKPAWRNDFQHDIVSDDGIDWSSNQNLINQTSLKPVDLPICSFAAAGNCPYGEGCPQMHGDLCATCGKLCLHPYRPDEREEHIKLCEKNHKRLVALKRSQEIECSVCLDRVLSKPTAAERKFGLLSECDHPFCIECIRNWRSNSPASGMDVNSALRACPICRKLSYYVIPSVLWYFSKEEKEEITESYKSKLKSIDCKYFDFGTGSCPFGTSCFYKHAYRDGRLEEVILRHLDADDGSTVIAKSIRLSDFLGRMDL

SEQ ID NO: 3824 - protein, 368 aa, Pennisetum glaucum
MSTNRVLCKFFMHGACLKGEYCEFSHDWKDQANNVCTFYQKGACSYGSRCRYDHVKVSRNPTVPPPPPSSSTARLASMSRQLSTSGHPPHTEHQTDSSNQRNQISVDVLAHSTSKPAWRNDCQHVVSEDEIDWSSNQTLQNQSKLKPSDLPICSFAAAGNCPYGEGCPQMHGDLCTTCGKMCLHPYRSDEREEHIKLCEKNHKRLDALKRSQEIECSVCLDRVLSKPTAAERKFGLLSECDHPFCIACIRNWRSNSPTSGMDVNSALRACPICRKLSYYVIPSVLWYFSKEEKDEIAESYKSKLKSIDCKYFDFGTGSCPFGTSCFYRHAYRDGRLEEVVLRHLDADDGSTVIAKKIRLSDFLSRMHL

SEQ ID NO: 3825 - protein, 370 aa, Sorghum bicolor
MATKKVLCKFFMHGACLKGEYCEFSHDWSDQANNVCTFYQKGACSYGSRCRYDHVKVSRNPTVPPPPSTSSAARRVTSNSLQLLSYSHAPHTGHQTDSSNQRHQISVDVLAHSASKPAWRNDFQHDIVSDDGIDWSSNRNLLNETSLKPADLPICSFAAAGNCPYGEGCPQMHGDLCATCGKMCLHPHRPDEREEHIKVCEKNHKRLEALKRSQEIECSVCLDRVLSKPTAAERKFGLLSECDHPFCIACIRNWRSNSPASGMDVNSALRACPICRKLSYYVIPSVLWYFSKEEKEEITESYKSKLKSIDCKYFDFGTGSCPFGTSCFYRHAYRDGRLEEVVLRHLDADDGSTVIAKDIRLSDFLGRMHL

SEQ ID NO: 3826 - protein, 333 aa, Secale cereale
MYPLEMEGTSNPKTNNKPKYSKFTQQELPACKPLLTPEIVIAAFALIGALFVPIGLASLHASRQVVELVHRYDASCVPVDDKVGFIQNSRTDKTCTVTMNVPKYMKSPIHVYYLIDGFYQNHRRYVKSRSDKQLRYKNAAHLTSDCVPEGITADRAPIVPCGLVAWSLFNDTYTVRVNGVVTQVNKKDIAWKSDKNNKFGKDIYPSNFQKGSLIGGAKLNESIPLSEQEDLIVWMRTAALPTFRKLYGRIEKDINANDNVTVVIQNNYNTYSFGGSKALVLSTASWIGGKNNFIGIAYLTIGGLCLSLAMGFLVLYMVKRRNFGDPSNLSWNR

SEQ ID NO: 3827 - protein, 333 aa, Triticum aestivum
MYPLEMEGNSNPKTTNKPKYSKFTQQELPACKPLLTPEIVIAAFALIGALFVPIGLASLHASRQVVELVHRYDASCVPVDDKVGFIQNSRTDKTCTVTMTVPKYMKSPIHVYYLIDGFYQNHRRYVRSRSDKQLRYKSAAHLTSDCVPEGDTADHAPIVPCGLVAWSLFNDTYTVRVNGVVTQVNKKDIAWKSDKNNKFGKNIYPSNFQKGRLIGGATLNESIPLSEQEDLIVWMRTAALPTFRKLYGRIEKDINANDNVTVVIQNNYNTYSFGGSKALVLSTASWIGGKNNFIGIAYLTIGGLCLSLAMGFLVLYMVKRRNFGDPSNLSWNR

SEQ ID NO: 3828 - protein, 328 aa, Triticum aestivum
MEGNSNPKTTNKPKYSKFTQQELPACKPLLTPEIVIAAFALIGALFVPIGLASLHASRQVVELVHRYDASCVPVDDKVGFIQNSRTDKTCTVTMTVPKYMKSPIHVYYLIDGFYQNHRRYVRSRSDKQLRYKSAAHLTSDCVPEGDTADHAPIVPCGLVAWSLFNDTYTVRVNGVVTQVNKKDIAWKSDKNNKFGKNIYPSNFQKGRLIGGATLNESIPLSEQEDLIVWMRTAALPTFRKLYGRIEKDINANDNVTVVIQNNYNTYSFGGSKALVLSTASWIGGKNNFIGIAYLTIGGLCLSLAMGFLVLYMVKRRNFADPSNLSWNR

SEQ ID NO: 3829 - protein, 333 aa, Brachypodium distachyon
MDPVKSDGDSKKCNKPKYSKFTQQELPACKPLLTPGIVIAAFSLIGVIFVPIGLASLSASREVVELVGRYDVSCVPDDDKVQFIQNSQSDKKCTITLNAPKYMKSPIHVYYQVSGFYQNHRRYVKSRSDKQLRYKSAVHLTKDCEPEDNAANGAPIVPCGLVAWSMFNDTYVVLVNSNAIEVNKKDIAWKSDKNHKFGKDIYPSNFQKGRLIGGAKLNESIPLSEQEDLIVWMRTAALPTFRKLYGRIEKDIMANDNITVVIQNNYNTYSFGGSKALVLSTTSWIGGKNNFIGIAYLTIGGLCLFLAMAFMVIYMLKTRTLGDPSYLSWNRDK

SEQ ID NO: 3830 - protein, 200 aa, Triticum aestivum
MDVPTAGQAAAVPQRKALEWEGRVVSPVPTATADEAWALLSDFLAFHKWHPRVAVCRLASSGAAAPGCVRYCEGTPPADGTPADWAHETLLEHDQARRFFRYEMNDNNMGFGAFFAAFRVVPAAAGGCVLRWEFECEPVRGTPKEALEARLQAGLDGMAARVHEHLMSARAAVAAAAPATAVTAGLEAADELKLDSSIAA

SEQ ID NO: 3831 - protein, 207 aa, Triticum aestivum
MDVPTAGGAAAAAPQRRAWEWEGRVVSPVPAATADEAWALLSDFLAFHKWHPRVAVCRLASASPSGAAAAPGCVRYCEGTPPGDGAPADWAHETLLEHDQARRFFRYEMNDNNMGFGAFFAAFRVVPAAHAAGGCELRWEFECEPVRGTPKEALEARLQAGLDGMAARVHEHLMSARAAVAAAAPAPAVAAGLEAADELKLDNSIAA

SEQ ID NO: 3832 - protein, 204 aa, Secale cereale
MDVPTAAQAAAVSQRKAWEWEGRVASPVPAATADEAWALLSDFLAFHKWHPRVAVCRLASSGAAAPGPGCVRYCEGTPPADGAPADWAHETLLEHDQARRFFRYEMNDNNMGFGAFFAVFGVVPAAAGGCELRWEFECEPVRSTPKEALEARLQAGLDGMAVRVHDHLMSARAAVAVAAAAPTTAVAAGLEAADELKLDNSIAA

SEQ ID NO: 3833 - protein, 199 aa, Leymus cinereus x Leymus triticoides
  misc_feature (6)..(6): Xaa can be any naturally occurring amino acid
  misc_feature (14)..(14): Xaa can be any naturally occurring amino acid
  misc_feature (18)..(18): Xaa can be any naturally occurring amino acid
  misc_feature (28)..(28): Xaa can be any naturally occurring amino acid
  misc_feature (180)..(180): Xaa can be any naturally occurring amino acid
MDVPTXAAVPQRKXWEWXGRVVSPVPAXTADEAWALLSDFLAFHKWHPRVAVCRLASSGAAAPGCVRYCEGTPPDDGTPADWAHETLLEHDQARRFFRYEMNDNNMGFGAFFAAFRVVPAAAGGCELRWEFECEPVRGTPKEALEARLQAGLDGMAARVHEHLMSARAAVAVAAAAPAPXVTAGLEAADELKLDNSIAA

SEQ ID NO: 3834 - protein, 205 aa, Pseudoroegneria spicata
  misc_feature (54)..(54): Xaa can be any naturally occurring amino acid
  misc_feature (117)..(117): Xaa can be any naturally occurring amino acid
  misc_feature (120)..(120): Xaa can be any naturally occurring amino acid
  misc_feature (127)..(127): Xaa can be any naturally occurring amino acid
MDVPTAGGAAAVTQRTAWEWEGRVVSPVPAATADEAWALLSDFLAFHKWHPRVXVCRLASSSGAAAPGCVRYCEGTPPDDGAPADWAHETLLEHDQARRFFRYEMNDNNMGFGTFFXVFXVVPAAAXGGCELRWEFECEPVRGTPKEALEARLQAGLDGMAARVHEHVMSARAAVAVATAATPPTTVTAGLEAADELKLDNSIAA

SEQ ID NO: 3835 - protein, 341 aa, Triticum aestivum
MAQTPPIPRVSLGTQGLEVSKLGFGCMGLTGSYNSPVEDDAGVAVITHAFRRGVTFFDTSDVYGPHANEILLGKALKQLPREQVQVATKFGIQRDAQGKSTICGRPEYVRACCEASLHRLGVDHIDLYYQHRIDTTIPIEDTIGELKKLVEEGKVKYIGLSEASPDTIRRAHAVHPISAVQMEWSLWARDIEPEIVPLCRELGIGIVPYSPIARGFFGGRGVTQQVSAESSLKGHPRFSAENLEKNKQLYLKMEELAKKHQCSPAQLALSWVLHQGDDVVPIPGTTKIKNLDSNIDSLKVRLTEDDLKEISNEIREEDVAGGRQYTSFAKFTWNYADTPKK

SEQ ID NO: 3836 - protein, 341 aa, Triticum aestivum
MAQTSPIPRVSLGTQGLEVSKLGFGCMGLTGSYNSPVEDDAGVAVITHAFNRGVTFFDTSDVYGPHANEILLGKALKQLPREQVQVATKFGIQRDAQGKSTICGRPEYVRACCEASLHRLGVHHIDLYYQHRIDTTIPIEDTIGELKKLVEEGKVKYIGLSEASPDTIRRAHAVHPISSVQMEWSLWARDIEPEIVPLCRELGIGIVPYSPIARGFFGGRGVTQQVSAESSLKGHPRFSAENLEKNKQLYLKIEELAKKHQCSPAQLALSWVLHQGDDVVPIPGTTKIKNLDSNIDSLKVRLTEDDLKEISNEIREEDVAGGRQYTSFAKFTWNYADTPKK

SEQ ID NO: 3837 - protein, 341 aa, Triticum aestivum
MAQTPPIPRVSLGTQGLEVSKLGFGCMGLTGSYNSPVEDDAGIAVITHAFRRGVTFFDTSDVYGPHANEILLGKALKQLPREQVQVATKFGIQRDAQGKSTICGRPEYVRACCEASLHRLGVHHIDLYYQHRIDTTIPIEDTIGELKKLVEEGKVKYIGLSEASPDTIRRAHAVHPISAVQMEWSLWARDIEPEIVPLCRELGIGIVPYSPIARGFFGGRGVTQQVSAESSLKGHPRFSAENLEKNKQLYLKMEELAKKHQCSPAQLALSWVLHQGDDVVPIPGTTKIKNLDSNIDSLTVRLTEDDLKEISNEIREEDVAGGRQYTSFAKFTWNYADTPKK

SEQ ID NO: 3838 - protein, 342 aa, Brachypodium distachyon
MEQTPLIPRVRLGTQGLQVSKLGFGCMGLTGAYNTPLDDDAGVAVIAHAFRRGVTFFDTSDVYGPHANEILLGKALKQLPREQVQVATKFGIQRDAAAGKSTVCGRPEYVRACCEASLRRLGLDHIDLYYQHRVDTTIPIEDTIGELKKLVEEGRVKYIGLSEASPDTIRRAHAVHPITAVQMEWSLWARDIEPQIVPLCRELGIGIVPYSPIARGFFGGRGVTQQVSAESSLKGHPRFSAENLEKNKLLYLKMEQLAEKHRCSPAQLALAWVLHQGDDVVPIPGTTKIKNLDSNIDSLKVKLTEDDLKEISSQIREEDVAGGRQYTSFAHTTWNYADTPKK

SEQ ID NO: 3839 - protein, 341 aa, Avena sativa
MAETPLIARVSLGTQGLEVSKLGFGCMGLTGAYNSPLGDDAGIAVIAHAFRRGVTFFDTSDVYGPHTNEALLGKALKQLPREQVQVATKFGIQRDSFGTGTVCGRPEYVRACCEASLRRLGLDHIDLYYQHRIDTTIPIEDTIGELKKLVEEGKVKYIGLSEASPDTIRRAHAVHPISAVQMEWSLWARDIEPEIVPLCRELGIGIVPYSPIARGFFAGRGVTEQVSAESNLKGHPRFSAENLEKNKLLYLKMEELAKKHQCSPAQLALAWVLHQGDDVVPIPGTTKIKNLDSNIDSVKLKLTKDELKEISDQVHEEDVAGGRQYTSFAHTTWNYADTPKK

SEQ ID NO: 3840 - protein, 343 aa, Avena sativa
MEETPVIPRVRLGTQGLEVSKLGLGCMGLTGSYNSPLDDDAGVAVITHAFRRGVTFFDTSDFYGPHANETLLGKALKRLPREQVQVATKFGIQLYEYGVGTGSVCGRPEYVRASCEASLRRLGVDHIDLYYQHRIDTTIPIEDTIGELKKLVEEGKVKYIGLSEASPDTIRRAHAVHPISAVQMEWSLWARDIEPDIVPLCRELGIGIVPYSPIGRGFFGGRGVTEQVSAESNLKGHPRFSAENLEKNKHLYLKMEELAKEHKCSPAQLALAWVLHQGDDVVPIPGTTKIKNLESNIDSLKVKLTEDGLKEISNQIREEDVAGGRSYSSFAHANWNYADTPKK

SEQ ID NO: 3841 - protein, 345 aa, Triticum aestivum
MEETPLPLIPRVRLGTQGLEVSKLGFGCMGLTGSYSAPLSDDAGASVVAHAFRRGVTFFDTSDFYGPHTNETLLGKALKQLPREQVQVATKFGIQEYAYDEGRGAVCGRPEYVRACCEASLRRLGVDYIDLYYQHRIDTTTPIEDTIGELKKLVEEGKVRYIGLSEASPDTIRRAHAVHPVSAVQMEWSLWARDIEPEIVPLCRELGIGIVPYSPIGRGFFGGRGVTEQVSAESNLKRHPRFSAENLEKNKHLYLKMEELARKHQCSPAQLALAWVLHQGDDVVPIPGTTKIKNLDSNIDSLKIKLTEDDLKEISSQIREEDVAGGRSYTSLAHTNWNHADTPKK

SEQ ID NO: 3842 - protein, 344 aa, Oryza sativa
MAEQAPLAPMPRVKLGTRGLEVSKLGFGCMGLTGAYNSPLDDDAGAAVIAHAFRRGVTFFDTSDVYGPLANEILLGKALKQLPREQVQVATKFGIRRGADGVRAVCGRPEYVRACCEASLGRLGVDYIDLYYQHRVDTTIPIEDTIGELKKLVEEGKVRYIGLSEASPDTIRRAHAVHPITAVQMEWSLWARDIEPEIVPLCRELGIGIVPYSPIARGFFGGRGVTEQLSAESNLQGHPRFSAENLEKNKQLYLKTEELAKKHQCSPAQLALAWVLHQGDDVVPIPGTTKIKNLDANIDSLKVNLTDDDLKEISSQVREEDVAGGRQYTSFAHYTWKYADTPKK

SEQ ID NO: 3843 - protein, 344 aa, Panicum virgatum
MADQAPLVPRVNLGTQGLEVSKLGFGCMGLTGAYNSPLDDEAGIAVITHAFRRGVTFFDTSDVYGPHANEILLGKALKQLPREKVQVATKFGIRRDGSGVATVCGKPEYVRACCEASLRRLGIDCIDLYYQHRIDTTIPIEDTISELKKLVEEGKVKYIGLSEASPDTIRRAHAVHPIAAVQMEWSLWSRDIEPEIVPLCRELGIGVVPYSPIGRGFFGGRGVTEQVSAESNLHGHPRFAAENLEKNKQIYLKMEELANKHQCSPAQLALAWVLHQGDDVVPIPGTTKIKNLDANIDALKVKLTDVDLKEIGSQIREEDVAGGRQYTSFAHTTWKYADTPKKQS

SEQ ID NO: 3844 - protein, 345 aa, Triticum aestivum
MEETPLPLIPRVRLGTQGLEVSKLGFGCMGLTGSYSAPLSDDAGASVVAHAFRRGVTFFDTSDFYGPHTNETLLGKALKQLPREQVQVATKFGIQEYAYDEGRGAVCGRPEYVRACCEASLRRLGVDYIDLYYQHRIDTTTPIEDTIGELKKLVEEGKVRYIGLSEASPDTIRRAHAVHPVSAVQMEWSLWARDIEPEIVPLCRELGIGIVPYSPIGRGFFGGRGVTEQVSAESNLKRHPRFSAENLEKNKHLYLKMEELAKKHQCSPAQLALAWVLHQGDDVVPIPGTTRIKNLDSNIDSLKIKLTEDDLEEISSQIREEDVAGGRSYTSLAHTNWNHADTPKK

SEQ ID NO: 3845 - protein, 344 aa, Panicum virgatum
MADQAPLVPRVKLGSQGLEVSKLGFGCMGLTGAYNSPLDDEAGIAVITHAFRRGVTFFDTSDVYGPRTNEILLGKALKQLPRDQVQVATKFGIQRDGSGVATVCGKPEYVRACCDASLRRLGIDCIDLYYQHRVDTTIPIEDTIGELKKLVEQGKVKYIGLSEASPDTIRRAHAVHPITAVQMEWSLWSRDIEPEIVPLCRELGIGIVPYSPIGRGFFGGRGVTEQVAAESNLHGHPRFAAENLEKNKQIYLKMEELANKHQCSPAQLALAWVLHQGDDVVPIPGTTKIKNLDANIDALKVKLTDEDLKEIGIQIREEDVAGGRQYTSFAHTTWKYADTPKKQS

SEQ ID NO: 3846 - protein, 341 aa, Avena sativa
MEQSLEIPRVRLGTQGLEVSKLGFGCMGLTGTYNSPLDDDAGISILVHAFRRGVTFFDTSDVYGPHTNETLVGKALKQLPREQVQVATKFGIRPATDGKSGVCGQPEYVRASCEASLRRLDVDYIDLYYQHRIDTTIPIEDTIGELKKLVEEGKVRYIGLSEASPDTIRRAHAVHPISAVQMEWSLWARDIEPEIVPLCRELGIGIVPYSPIGRGFFGGRGVTEQLSAQSSLKGHPRFLAENLEKNKHLYLKIEQLAKKHQCTPAQLALAWVLHQGDDTVPIPGTTKIKNLDANIDSLKVKLTNDDLKEISNQIREEDVAGGRPYNSLAHTTWKNANTPKL

SEQ ID NO: 3847 - protein, 344 aa, Sorghum bicolor
MANQAPPVPRVKLGTQGFEVSKLGFGCMGLTGAYNSPLDDEAGIAVITHAFSRGITFFDTSNVYGPLTNEILLGKALKQLPREQVQVATKFGILRDESGNRTVCGRPEYVRACCEASLRRLDIDCIDLYYQHRIDTTIPIEETIGELKKLVEEGKVKYIGLSEASPDTIRRAHAVHPITAVQMEWSLWSRDIEPEIVPLCRELGIGIVPYSPLGRGFFGGRGVKEQVSAESVLHGIPRFAPENLEKNKQIYLRMEELANKHQCSPTQLALAWVLHQGNDVVPIPGTTKIKNLDSNIDSLKVKLTDEDLKEMGSQIREEDVAGGRQFASFEHATWKYADTPKKQS

SEQ ID NO: 3848 - protein, 344 aa, Setaria italica
MEEAAPPQVPRVKLGAQGLEVSKLGFGCMGLTGSYNAPLGDEAVAAVVEHAFRRGVTFFDTSDAYGPHTNETLLGRALQRLPRGQVQVATKFGVGQGGAGGGLTICGTPEYARACCEASLRRLGVGYIDLYYQHRIDTTVPIEDTIGELKKLVEEGKVKYIGLSEASPDTIRRAHAVHPITAVQMEWSLWSRDIEPEIVPLCRELGIGIVPYSPIGRGFFGGRGVTQQVSSESSLQRHPRFTADNLEKNKQLYLKMEDLAKKHQCSPAQLALAWVLHQGDDVVPIPGTTKIKNLDANIDSLKVKLTEEDMKEITSQIRADDVAGGRQYNSYAHTAWKYADTPKK

SEQ ID NO: 3849 - protein, 345 aa, Zea mays
MDTQARPVPPRVKLGIQGFEVSKLGFGCMGLTGAYNSPLDDEAGIAVIAHAFSRGVTLFDTSDVYGPLTNEILLGKALKQLPREQVQVATKFGIRHDESGTRTVCGRPEYVRACCEASLRRLGIDCIDLYYQHRIDTTTPIEETIGELKKLVEEGKVKYIGLSEASPDTIRRAHAVHPITAVQMEWSLWSRDIEPEIVPLCRELGIGIVPYSPLGRGFFGGRGVKEQVSAESNLHGIPRFAPENLEKNKQIYLRMEELANKHQCSPAQLALAWVLHQGDDVVPIPGTTKIKNLDSNIDSLKVKLTDEDLKEMGSQIREEDVAGGRQFTSFAHTTWKYADTPKKQS

SEQ ID NO: 3850 - protein, 344 aa, Setaria italica
MEEAAPPQVPRVKLGAQGLEVSKLGFGCMGLTGSYNAPLGDEAVAAVVEHAFRRGVTFFDTSDAYGPHTNETLLGRALQRLPRGQVQVATKFGVGQGGAGGGLTICGTPEYARACCEASLRRLGVGYIDLYYQHRIDTTVPIEDTIGELKKLVEEGKVKYIGLSEASPDTIRRAHAVHPITAVQMEWSLWSRDIEPEIVPLCRELGIGIVPYSPIGRGFFGGRGVTQQVSSESSLQRHPRFTADNLEKNKQIYLKMEDLAKKHQCSPAQLALAWVLHQGDDVVPIPGTTKIKNLDANIDSLKVKLTEEDMKEITSQIRADDVAGGRQYNSYAHTAWKYADTPKK

SEQ ID NO: 3851 - protein, 344 aa, Setaria italica
MEEAAPPQAPRVKLGAQGLDVSKLGFGCMGLTGSYNAPLGDEAVAAAVEHAFRRGVTFFDTSDAYGPHTNETLLGRALQRLPRGQVQVATKFGVGQGGAGGGLTVCGTPEYARACCEASLRRLGVSYIDLYYQHRIDTTVPIEDTIGELKKLVEEGKVKYIGLSEASPDTIRRAHAVHPITAVQMEWSLWSRDIEPEIVPLCRELGIGIVPYSPIGRGFFGGRGVTQQVSSESSLQSHPRFTADNLEKNKQIYLKMEDLAKKHQCSPAQLALAWVLHQGDDVVPIPGTTKIKNLDANIDSLKVKLTDEDMKEITSQIRADDVAGGRQYNSYAHTAWKYADTPKK

SEQ ID NO: 3852 - protein, 349 aa, Sorghum bicolor
MEEEQAAAIQVVVPRVKLGAQGLEVSKLGFGCFGLTGAYGSAALDDEAAAAVIAHAFRRGVTFFDTSDIYGPLTNEILLGKQLKQLPREQVQVATKFGLARDDASGAWTVCGRPEYVRACCEASLRRLGVHCIDLYYLHRVDTTVPIEDTIGELKKLVEEGKVKYIGLSEASPDTIRRAHAVHPITAVQMEWSLWSRDIEPEIVPLCRELDIGIVPYSPIGKGFFGGRGVTEQVSAASNLRRHPRFSAENLEKNKQIYLKMEELANKHRCSPAQLALAWVLHQGDDVIPIPGTTKIKNLDANIDSLKVKLTDDDLKEISSEIREEDVAGARQNTSFGPTNWNYADTPRK

SEQ ID NO: 3853 - protein, 343 aa, Sorghum bicolor
MEPAALPQVPRVKLGTQGLEVSKLGFGCMGLTGSYNAPLGDEAVAAVVAHAFRRGVTFFDTSDAYGPHTNETLLGKALKQLPREQVQVATKFGIGQGAAGGMTVCGTPEYVRACCEASLRRLDAGYIDLYYQHRVDTTVPIEDTIGELKKLVEEGKVKYIGLSEASPDTIRRAHAVHPITAVQMEWSLWSRDIEPEIVPLCRELGIGIVPYSPIGRGFFAGRGVTQEVSSVSSLQRHPRFTAESLEKNKQIYLKIEDLAKKYQCSPAQLALAWVLHQGDDVVPIPGTTKTKNLDANVESLKVKLTAEDLEEIASQIRAEDVAGGRQYNSYAHTSWKYADTPKK

SEQ ID NO: 3854 - protein, 344 aa, Panicum virgatum
MEQAAPPPQVPRAKLGTQGLEVSKLGFGCMGLTGSYNAPLGDEAVAAVVEHAFRRGVTFFDTSDAYGPHTNETLLGRALGRLPRGQVQVATKFGIGQGAAGGLTVCGEPEYVRACCEASLRRLGVSYIDLYYQHRVDITVPIEDTIGELKKLVEEGKVKYIGLSEASPDTIRRAHAVHPITAVQMEWSLWSRDIEPEIVPLCRELGIGIVPYSPIGRGFFAGRGVTQQVSSESSLQKHPRFAADNLEKNKQIYLKMEDLAKKHQCSPAQLALAWVLHQGDDVVPIPGTTKTKNLEANIDSLKVKLTDEDLKEITSQIRADDVAGGRQYNSYAHTAWKYADTPKK

SEQ ID NO: 3855 - protein, 108 aa, Triticum aestivum
MTTKAKLGELMWEHRLRAAAAVAFLAVAVVSISAVGPRLGAVVSFFWPLLVSTGFFLVAITVLLRISPPPSGAEESGKEIIDFVAGCRPEHLLPEASATVEVPPEPEI

SEQ ID NO: 3856 - protein, 110 aa, Brachypodium distachyon
MASKAKLGELMWEHRLRAAAVVAFLAAAVVSISAVGPRLSAVVSFFWPLLVSTAFFLVAITVLLRISPPPAGADESGKDLIDFVAGCRPEHLVPLPEASTTVEVPPEPEI

SEQ ID NO: 3857 - protein, 110 aa, Setaria italica
MATKSKLGELMWEHRLQAAAAVAFVAAAAVSISAVGPRLGAVVSFFWPLLVSTGFLLVAITVLLRISPPPAGADESGKELIDFVAGCRPEHLVPEAAAAASVEAPPEPEI

SEQ ID NO: 3858 - protein, 431 aa, Secale cereale
MLEGKSCLVSRSLPSYCDPESDWGFLLSGSKRPAPEDFGAEDMEEVDAGGSSSGKRSKSPSPQPHTPDITESHGSSRHASSGSGGGEQQGSGANLIGEIGRDLSINCLLRLSRSDYGSVASLNRDFNSLVRNGEIYRLRRQNGIAEHWVYFSCNVLEWDAYDPYRERWIQVPKMPPDECFMCSDKESLAVGTELLVFGMAHIVFRYSILTNSWTRADPMNSPRCLFGSTSVGEKAYVAGGTDASGKILSSAEMYDSVTHTWTPLPSMNRARKMCSGVFLDGKFYVIGGVTNNNQVLTCGEEYDLNRGSWRVIENMSEGLNGVTGAPPLIAVVNNQLYAADYSEKDVKKYDKLNNKWIALGKLPERSVSMNGWGLAFRACGDRLIVIGGPRTSIGGIIELNSWVPDEQPPVWNLVATRQSGNFVYNCAVMGC

SEQ ID NO: 3859 - protein, 431 aa, Secale cereale
MLEGKSCLVSRSLPSYCDPESDWGFLLSGSKRPAPEDFGAEDMEEVDAGGSSSGKRSKSPSPQPHTPDITESHGSSRHASSGSSGGEQQGSGANLIGEIGRDLSINCLLRLSRSDYGSVASLNRDFNSLVRNGEIYRLRRQNGIAEHWVYFSCNVLEWDAYDPYRERWIQVPKMPPDECFMCSDKESLAVGTELLVFGMAHIVFRYSILTNSWTRADPMNSPRCLFGSTSVGEKAYVAGGTDASGKILSSAEMYDSVTHTWTPLPSMNRARKMCSGVFLDGKFYVIGGVTNNNQVLTCGEEYDLNRGSWRVIENMSEGLNGVTGAPPLIAVVNNQLYAADYSEKDVKKYDKLNNKWIALGKLPERSVSMNGWGLAFRACGDRLIVIGGPRTSIGGIIELNSWVPDEQPPVWNLVATRQSGNFVYNCAVMGC

SEQ ID NO: 3860 - protein, 431 aa, Triticum aestivum
MLEGKSCLVSRSLPSYCDPDSDWAFLLSGSKRPAPEDFGAEDMEEVDAGGGSGKRSKSPSPQPHTPDITESHGSSRHASSGSSGGGEQQGSGANLIGEIGRDLSINCLLRLSRSDYGSVASLNRDFNSLVRNGEIYRLRRQNGIAEHWVYFSCNVLEWDAYDPYRERWIQVPKMPPDECFMCSDKESLAVGTELLVFGMAHIVFRYSILTNSWTRADPMNSPRCLFGSTSVGEKAYVAGGTDASGKILSSAEMYDSVTHTWTPLPSMNRARKMCSGVFLDGKFYVIGGVTNNNQVLTCGEEYDLNRGSWRVIENMSEGLNGVTGAPPLIAVVNNQLYAADYSEKDVKKYDKLNNKWIALGKLPERSVSMNGWGLAFRACGDRLIVIGGPRTSIGGIIELNSWVPDEQPPVWNLVATRQSGNFVYNCAVMGC

SEQ ID NO: 3861 - protein, 431 aa, Triticum aestivum
MLEGKSCLVSRSLPSYCDPDSDWAFLLSGSKRPAPEDFRAEDMEEVDAGGSSSGKRSKSPSPQPHTPDITESHGSSRHASSGSGGGEQQGSGANLIGEIGRDLSINCLLRLSRSDYGSVASLNRDFNSLVRNGEIYRLRRQNGIAEHWVYFSCNVLEWDAYDPYRERWIQVPKMPPDECFMCSDKESLAVGTELLVFGMAHIVFRYSILTNSWTRADPMNSPRCLFGSTSVGEKAYVAGGTDASGKILSSAEMYDSVTHTWTPLPSMNRARKMCSGVFLDGKFYVIGGVTNNNQVLTCGEEYDLNRGSWRVIENMSEGLNGVTGAPPLIAVVNNQLYAADYSEKDVKKYDKLNNKWIALGKLPERSVSMNGWGLAFRACGDRLIVIGGPRTSIGGIIELNSWVPDEQPPVWNLVATRQSGNFVYNCAVMGC

SEQ ID NO: 3862 - protein, 430 aa, Triticum aestivum
MLEGKSCLVSRSLPSYCDPDSDWAFLLSGTKRSAPEDFGAEDMEEVDAGGSSGKRSKSPSPQPHTPDITESHGSSRHASSGSGGGEQQGSGANLIGEIGRDLSINCLLRLSRSDYGSVASLNRDFNSLVRNGEIYRLRRQNGFAEHWVYFSCNVLEWDAYDPYRERWIQVPKMPPDECFMCSDKESLAVGTELLVFGMAHIVFRYSILTNSWTRADPMNSPRCLFGSTSVGEKAYVAGGTDASGKILSSAEMYDSVTHTWTPLPSMNRARKMCSGVFLDGKFYVIGGVTNNNQVLTCGEEYDLNRGSWRVIENMSEGLNGVTGAPPLIAVVNNQLYAADYSEKDVKKYDKLNNKWIALGKLPERSVSMNGWGLAFRACGDRLIVIGGPRTSIGGIIELNSWVPDEQPPVWNLVATRQSGNFVYNCAVMGC

SEQ ID NO: 3863 - protein, 430 aa, Triticum aestivum
MLEGKSCLVSRSLPSYCDPDSDWAFLLSGTKRSAPEDFGAEDMEEVDAGGSSGKRSKSPSPQPHTPDITESHGSSRHASSGSGGGEQQGSGANLIGEIGRDLSINCLLRLSRSDYGSVASLNRDFNSLVRNGEIYRLRRQNGFAEHWVYFSCNVLEWDAYDPYRERWIQVPKMPPDECFMCSDKESLAVGTELLVFGMAHIVFRYSILTNSWTRADPMNSPRCLFGSTSVGEKAYVAGGTDASGKILSSAEMYDSVTHTWTPLPSMNRARKMCSGVFLDGKFYVIGGVTNNNQVLTCGEEYDLNRGSWRVIENMSEGLNGVTGAPPLIAVVNNQLYAADYSEKDVKKYDKLNNKWIALGKLPERSVSMNGWGLAFRACGDRLIVIGGPRTSIGGIIELNSWVPDGQPPVWNLVATRQSGNFVYNCAVMGC

SEQ ID NO: 3864 - protein, 435 aa, Avena sativa
MLEGQSCLVSRSLPGCCEPEPDWAYLAHEVSVLGGKRPAPDEDFDLEDMDGGGGSSSGKRSKSPSPQPHTPDITEGHGSSRHVSSGAAAGDQQGSGSNLIGEIGRDLSINCLLHLSRSDYGSVASLNRDFNSLVRNGEIYRLRRQNGIAEHWVYFSCNVLEWDAYDPYRQRWIQVPKMPPDECFMCSDKESLAVGTQLLVFGMAHIVFRYSILTNSWTRADPMNSPRCLFGSTSVGEKAYVAGGTDASGKILSSAEMYDSETHIWTPLPPMHKERKMCSGVFMDGKFLVIGGVTHNNKVLTCGEEYDLKRQSWRVIENMSEGLNGVTGAPPLVAVVNNELYAADYSEKDVKKYDKLNNKWITLGKLPERSVSMNGWGLAFRACGDRLIVIGGPRTSIGGMIELNSWVPDQQPPVWNLVARRPSGNFVYNCAVMGC

SEQ ID NO: 3865 - protein, 430 aa, Oryza sativa
MLEGNSCLISRSLPSSCEPESQWAYLSHEVLNGKRPAPEDAEAEDMDEVDFGGGKRSKPPSPQPHTPDISEGHGSSRHVAASGGGEEHGNGSSLIGAIGRDLTINCLLRLSRSDYGSVASLNKDFRSLVRNGEIYRLRRQSGVAEHWVYFSCNVLEWDAYDPYRERWIQVPKMPPDECFMCSDKESLAVGTELLVFAMAHIVFRYSILTNSWTRADPMISPRCLFGSTSVGAKAYVAGGTDSSGRILSSAEMYDSETHSWTPLPSMNRARKMCSGVFMDGKFYVVGGVASNNKVLTCGEEYDLKRRSWRVIENMSEGLNGVTGAPPLIAVVNNELYAADYSEKDVKKYDKQNNKWITLGKLPERSVSMNGWGLAFRACGDRLIVIGGPRTSIGGTIELNSWTPDERPPVWNLIARRPSGNFVYNCAVMGC

SEQ ID NO: 3866 - protein, 427 aa, Sorghum bicolor
MLEGKSYLVSRSLPSSCEPETEWAYLAHEVLSGKRPTPEDVEVEDLDEADGGGKRSKPPSPQPHTPDICEGHGSSRHASGCGEQQGTGSNPMNSIGRDLTINCLLRLSRSDYGSVASLSRDFRAMVRSGEIYRLRRQSGVAEHWVYFSCNVLEWDAYDPYRERWIQVPKMPPDECFMCSDKESLAVGTQLLVFAMAHIVFRYSILTNSWTMADPMNSPRCLFGSTSVGEKAFVAGGTDSGGNILSSAEMYDSETHTWTPLPSMNRARKMCSGVFMDGKFYVIGGVANNNRVLTCGEEYDLKRRSWRIIENMSEGLNGVTGAPPLIAVVNNELYAADYSEKDLKKYDKKNNRWITLGKLPERSVSMNGWGLAFRACGDRLIVIGGPRTYTGGTIELNSWIPDERPPVWNLIARRPSGNFVYNCAVMGC

SEQ ID NO: 3867 - protein, 422 aa, Panicum virgatum
MLEGQSYLVSRSLPSSCEPETEWAYLADQVLSGKRPAPEDVEEADGGGKRSKPPSPQPHTPDITEGHGSSRHASGGGEPQGTGSNPINSIGRDLTINCLLRLSRSDYGSVASLSRDFRSLVRSGEIYRLRRQNGVAEHWVYFSCNVLEWDAYDPYRDRWIRVPKMPPDECFMCSDKESLAVGTELLVFGMARIVFRYSILTNSWTRADAMNSPRCLFGSTSVGEKAFVAGGTDSMGTILSSAEMYDSESHTWTPLPSMNRARKMCSGVFMDGKFYVIGGVANNNKVLTCGEEYDLKRRSWRIIENMSEGLNGVTGAPPLIAVVNNELYAADYSEKDLKKYDKKNNKWITLGKLPERSVSMNGWGLAFRACGDRLIVIGGPRTYTGGTIELNSWIPNDQPPVWNMIARRPSGNFVYNCAVMGC

SEQ ID NO: 3868 - protein, 427 aa, Saccharum officinarum
MLEGKSYLVSRSLPSSCEPETEWAYLAHEVLSGKRPAPEDVEVEDLDEADGGGKRSKPPSPQPHTPDICEGHGSSRHASGCGEQQGTGSNPMNSIGRDLTINCLLRLSRSDYGSVASLSRDFRAMVRSGEIYRLRRQNGVAEHWVYFSCNVLEWDAYDPYRERWIQVPKMPPDECFMCSDKESLAVGTQLLVFGMARIVFRYSILTNSWTRADPMNSPRCLFGSTSVGGKAFVAGGTDSIGNILSSAEMYDSETLTWTPLPSMNRARKMCSGVFMDGKFYVIGGVANNNRVLTCGEEYDLKRRSWRIIENMSEGLNGVTGAPPLIAVVSNELYAADYSEKDLKKYDKKNNRWITLGKLPERSVSMNGWGLAFRACGDRLIVIGGPRTYTGGTIELNSWIPNERPPVWNLIARRPSGNFVYNCAVMGC

SEQ ID NO: 3869 - protein, 427 aa, Setaria italica
MLEGKSYLVSRSVPSSCEAETEWAYLANEVLSGKRPAPEDVGVEGLDEADGGGKRSKPPSPQPHTPDITEGHGSSRHASGGKEQQATGSNPIHSIGRDLTINCLLRLSRSDYGSVASLSRDFRSLVRSGEIYRLRRQNGVAEHWVYFSCNVLEWDAYDPYRDRWIRVPKMPPDECFMCSDKESLAVGTELLVFGMARIVFRYSILTNSWSRADAMNYPRCLFGSTSVGEKAFVAGGTDSLGTILSSAEMYDSENHTWTLLPSMNRARKMCSGVFMDGKFYVIGGVANNNKVLTCGEEYDLKRCSWRIIENMSEGLKGVTGAPPLIAVVNNELYAADYSEKDLKKYDKKNNKWITLGKLPERSVSMNGWGLAFRACGDRLIVIGGPRTYTGGTIELNSWIPNDRPPVWNLIARRPSGNFVYNCAVMSC

SEQ ID NO: 3870 - protein, 427 aa, Zea mays
MLEGKSYLVPRSLLSSCETETQWAYLAHEVLGGKRPAPEDVEVEDLDEADGGGKRSKPPSPQPHTPDISEGRGSSRHASGCGEQQGTGSNPMNSIGRDLTLNCLLRLSRSDYGSVASLSRDFRSMVRSGEIYRLRRQNGVAEHWVYFSCNVLEWDAYDPYRERWIQVPKMPPDECFMCSDKESLAVGTELLVFGMARIVFRYSILTNSWTRAHPMNSPRCLFGSTSVGEKAFVAGGTDSIGNILSSAEMYDSETHTWTPLPSMNRARKMCSGVFMDGKFYVIGGVANNNKLLTCGEEYDLKRRSWRIIENMSEGLNGVTGAPPLIAVVSNELYAADYSENDLKKYDKKNNRWITLGKLPERSVSMNGWGLAFRACGDCLIVIGGPRTYTGRTIELNSWTPNERPPVWNLIARRPSGNFVYNCAVMGC

SEQ ID NO: 3871 - protein, 428 aa, Zea mays
MLEGKSYLVSRSVPSSCEPEAEWEYLAHAVLSGKRPAPEDDVEVEDPDETGSGGKRSKPPSPQPHTPDICEGHGSNRHATGSGEQRITGSNPMTSIGRDLTLNCLLRLSRSDYGSVASLSRDFRSMVRSGEIYRLRRQNGVAEHWVYFSCNVLEWDAYDPYRERWIQVPKMPPDECFKCSDKESLAVGTELLVFGMARIVFRYSILTNSWSRADPMNSPRCLFGSTSVGGKAFVAGGTDCVGNILSSAEMYDSETHTWTPLPSMNTARKMCSGVFMDGKFYVIGGVANSNRVLTCGEEYDLKRGSWRTIENMSGGLNGVTGAPPLIAVVSNELYAADYGEKDLKKYDKKNNRWITLGKLPERSVSMNGWGLAFRACGDRLIVIGGPRTYTGGTIELNSWIPDERPPVWNLIARRPSGNFVYNCAVMGC

SEQ ID NO: 3872 - protein, 423 aa, Pennisetum glaucum
MLEGKSYLVSRCLPSSCEAETEWAYLANEVLSGKRPAPEDVGVEGFDEADGGGKRSKPPSPQPHTPEITEGHGSCRHASGGKEQQDTGSNPIHSIGRDLTINCLLRLSRSDYGSVASLSRDFRSLVRTGEIYRLRRQSGVAEHWVYFSCNVLEWDAYDPYRDRWIRVPKMPPDECFMCSDKESLAVGTELLVFGMARIVFRYSILTNSWSRADPMNYPRCLFGSTSVGEKAFVAGGTDPLGNILSSAEMYDSENHTWTLLPSMNRARKMCSGVFMDGKFYVVGGVANNNKVLTCGEEYDLKRRSWRIIENMSEGLKGVTGAPPLIAVVNNELYAADYSEKDLKKYDKKNNKWITLGRSVSMNGWGLAFRACGDRLIVIGGPRTYTGGTIELNSWIPNDRPPVWNLIARRPSGNFVYNCAVMSC

SEQ ID NO: 3873 - protein, 514 aa, Triticum aestivum
MDSLLWFVELLSLLCFFVFYYRHLQSKKISKAEPTEWPILGHLFGMVANLSHFHDWATGILAGTRYNFEARAGITGVRFFVTCDPANVRHIFTSNFANYPKGDEFAEIFDVFGDGIFNADGDSWRRQRAKSQLIMAGPRFRAFSARYSRDKVERSLLPFLAHAAEAGSTPCDLHDVFLRLTFDMTCNLVFGVDPGCLQIDLPVVPFARAMDDVLETLFLRHIISPACWKLMYRYEVGTERKMAAARRTIDRFAADTIAKRRADHKLGDEGVTDSSDMLSSFICNGDASEYSDDFLRDTTVNLLLAGRDTTGAALSWFFYLLSKNPRVEQKILDELAPIASRKKQLAGDDGMAVFDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNFAVKTVPGHVVEPKLSIILHMKNGLAVTVKRRNVAGVHG

SEQ ID NO: 3874 - protein, 517 aa, Pseudoroegneria spicata
DSFYWCVELLSLLCFFVFYYRHLQSKKISKEEPTEWPILGHLFGMVANLSHFHDWATGILTGTRYNFEARAGITGVRFFVTCDPANVRHIFTSNFANYPKGEEFADIFDVFGDGIFNADGESWRRQRAKSQLIMSGPRFRAFSARYSRDKVERSLLPFLLAHAADAGTPCDLHDVFLRLTFDMTCNLVFGVDPGCLQIGLPVVPFARAMDDVLETLFLRHIISPACWKLMYRYEVGTERKMAAARRTIDRFAADTIAQRRADHKLRDEVVSDSSDMLSSFICNGDASEYSDEFLRDTTVNLLLAGRDTTGAALSWFFYLLSKNPRVEQKILDELAPVASRKKKKQAGDDDDDDMVVFDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNFAVEAVPGHVVEPKLSIILHMKNGLAVTVKRRNAAPVHG

SEQ ID NO: 3875 - protein, 522 aa, Brachypodium distachyon
MDPLYWLVELLSLLCCFIFYYRHLQSKKISKREPTEWPVLGHLFGMIAHKNDFHDWATGILAGTRYNFEARAGVTGVRFFVTCDPANVRHIFTSNFANYPKGDEFAEIFDVFGNGIFNADGESWRRQRAKSQLLMAGPRFRAFSAEYSRDKVEKSLLPFLEHAADAGTACDLHDVFLRLTFDMTCNLVFGVDPGCLAIGLPEIPFARAMDDVLETLFLRHLISPACWKLMYRLELGPEKKMAVARRTIDRFAAETIAKRRADSHETSAAHGADMLSSFIGQDDHTGEYSDEFLRDTTVNLLLAGRDTTGAALAWFFYLLSQNPRVEQKILAELAPIASQKKKAMDGDGDTDTGNMVVFDVSELSNMVYLHAALCECLRLYPSVPFEHKAAVASDVLPSGHEMKAGDKILIFSYCMGRMEGVWGKDCAEFRPERWVSEDVDGKKRLRYEPSYKFISFNAGPRTCLGKEMAFVQMKTAAAAVLWNFVVRAVPGHVVEPKLSIILHMKNGLAVTVKRRTGLHGGA

SEQ ID NO: 3876 - protein, 104 aa, Triticum aestivum
MDEQEFRRMLDLFPVVRSRDYCKDEVESSSEGTTQQTRAQEIKGTKKNAAEALFLRKLKMAAEKKVGATKAELFCKTFEEAHEKLVYKELDLDAAQRFLNAYKS

SEQ ID NO: 3877 - protein, 62 aa, Secale cereale
MDEQEFRRMLELFPIVRSRDYCKDEVESSSEGTTQQTRAQEIKGTKKEGCRSSIPAEIEDGC

SEQ ID NO: 3878 - protein, 104 aa, Secale cereale
MDEQEFRRMLELFPVVRSRDYCKDEVESSSEGTTQQTRAQEIKGTKKKAAEALFLRKLKMAAEKKIGATKAELFCKTFEEAHEKLVYKELDLNAAQRFLNAYKS

SEQ ID NO: 3879 - protein, 106 aa, Avena sativa
MDEQEFRSMLELFPVVRSRDYCKAELESSSKGTTQQAQAQETKGTKKEPSAAEDLFLRKLKMSAAKKVGATKAELFCKTFEEAHNKLVYKELNLDAAQRFLDAYKN

SEQ ID NO: 3880 - protein, 106 aa, Brachypodium distachyon
MDEQEFRRMLDLFPVVRSRDYCKPESESSSKGTTQQARSLQIEGPKKEPSAAEDLFLRKLKLAAEKKVGATKAELFCKTFEEAHEKLVYKELNLDAAQRFLDAYKS

SEQ ID NO: 3881 - protein, 106 aa, Avena sativa
MDEQEFRSMLELFPIVRSRDYCKAELESSSKGTTQQARAQETKRTKKEPSAAEDLFLRKLKMSAAKKVGATKAELFCKTFEEAHNKLVYKELNLDAAQRFLDAYKN

SEQ ID NO: 3882 - protein, 106 aa, Festuca arundinacea
MDEQEFRSMLDLFPVVRSRDYCKAELESSSKGTAQQAQAQGTKGTNKEPSAAEDVFLRKLKMAAAKKVGATKAELFCKTFEEAHNKLVYKELNLDAAQRFLNVYKN

SEQ ID NO: 3883 - protein, 492 aa, Secale cereale
MKEMMVGSVAPVGPVGRWGAAPPQELLERMKDYGQEGAFALWDELSPEDRDLLVRDIESLDLSRIDRIIRRSMGSEGYVAPAEPVPESSVSRVEERSPEDKERWWKKGLRAISEGRLAVVLLAGGQGTRLGSSDPKGCFSIGLPSGKSLFQLQAERILCIQKLAAQSSDSPRNTLPIHWYIMTSPFTDDVTRKFFESRKYFGLEADQVTFFQQGTLPCVSDDGRFIMETPYKVAKAPDGNGGVYAALKSKKLLDDMSSRGVKYVDCYGVDNVLVRVADPTFLGYFIEKGVSSAAKVVRKAYPQENVGVFVQRGRGGPLSVVEYSEMDAAMTTEINQSTGRLRYCWSNVCLHMFSLEFLNQVANSLEKDSVYHLAQKKIPSIHGYTMGLKLEQFIFDAFNYSPSTTLFEVLREEEFAPVKNANGSAYDTPDSAKLMLLRLHSRWVVAAGGFLTHSVPLYMTGVEVSPLSSYAGENLEAICRGRTFHAPSEISF

SEQ ID NO: 3884 - protein, 492 aa, Secale cereale
MKEMMVGSVAPVGPVGRWGAAPPQELLERMKDYGQEGAFALWDELSPEDRDLLVRDIESLDLSRVDRIIRRSMGSQGYVAPAEPVPESSVSRVEERSPEDKERWWKKGLRAISEGRLAVVLLAGGQGTRLGSSDPKGCFSIGLPSGKSLFQLQAERILCIQKLAAQSSDSPRNTLPIHWYIMTSPFTDDVTRKFFESRKYFGLEADQVTFFQQGTLPCVSDDGRFIMETPYKVAKAPDGNGGVYAALKSKKLLDDMSSRGVKYVDCYGVDNVLVRVADPTFLGYFIEKGVSSAAKVVRKAYPQENVGVFVQRGRGGPLSVVEYSEMDAAMTTEINQSTGRLRYCWSNVCLHMFSLEFLNQVANSLEKDSVYHLAQKKIPSIHGYTMGLKLEQFIFDAFNYSPSTTLFEVLREEEFAPVKNANGSAYDTPDSAKLMLLRLHSRWVVAAGGFLTHSVPLYMTGVEVSPLSSYAGENLEAICRGRTFHAPSEISF

SEQ ID NO: 3885 - protein, 493 aa, Triticum aestivum
MKEMMVGSVAPVGPVGRWGAAPPQELLERMKDYGQEGAFALWDELSPEDRDLLVRDIESLDLSRIDRIIRRSMGSQGGYLAPAEPVPESSVSRVEERSPEDKERWWKKGLRAISEGRLAVVLLAGGQGTRLGSSDPKGCFSIGLPSGKSLFQLQAERILCIQKLAAQSSDSPRNTLPIHWYIMTSPFTDDVTRKFFESCKYFGLEADQVTFFQQGTLPCVSDDGRFIMETPYKVAKAPDGNGGVYAALKSKKLLDDMSSRGVKYVDCYGVDNVLVRVADPTFLGYFIEKGVSSAAKVVRKAYPQENVGVFVQRGRGGPLSVVEYSEMDAAMTTEINQSTGRLRYCWSNVCLHMFSLEFLNQVANSLEKDSVYHLAQKKIPSIHGYTMGLKLEQFIFDAFNYSPSTTLFEVLREEEFAPVKNANGSAYDTPDSAKLMLLRLHSRWVVAAGGFLTHSVPLYMTGVEVSPLSSYAGENLEAICRGRTFHAPSEISF

SEQ ID NO: 3886 - protein, 493 aa, Triticum aestivum
MKEMMVGSVAPVGPVGRWGAAPPQELLERMKDYGQEGAFALWDELSPEDRDLLVRDIESLDLSRIDRIIRRSMGSQGGYLAPAEPVPESSVSRVEERSPEDKERWWKKGLRAISEGKLAVVLLAGGQGTRLGSSDPKGCFSIGLPSGKSLFQLQAERILCIQKLAAQSSDSPRNTLPIHWYIMTSPFTDDVTRKFFESRKYFGLEADQVTFFQQGTLPCVSDDGRFIMETPYKVAKAPDGNGGVYAALKSKKLLDDMSSRGVKYVDCYGVDNVLVRVADPTFLGYFIEKGVSSAAKVVRKAYPQENVGVFVQRGRGGPLSVVEYSEMDAAMTTEINQSTGRLRYCWSNVCLHMFSLEFLNQVANSLEKDSVYHLAQKKIPSIHGYTMGLKLEQFIFDAFNYSPSTTLFEVLREEEFAPVKNANGSAYDTPDSAKLMLLRLHSRWVVAAGGFLTHSVPLYMTGVEVSPLSSYAGENLEAICRGRTFHAPSEISF

SEQ ID NO: 3887 - protein, 464 aa, Triticum aestivum
MKDYGQEGPFALWDELSPEDRDLLVRDIESLDLSRIDRIIRRSMGSQGGYLAPAEPVPESSVSRVEERSPEDKERWWKKGLRAISEGKLAVVLLAGGQGTRLGSSDPKGCFSIGLPSGKSLFQLQAERILCIQKLAAQSSDSPRNTLPIHWYIMTSPFTDDVTRKFFESRKYFGLEADQVTFFQQGTLPCVSDDGRFIMETPYKVAKAPDGNGGVYAALKSKKLLDDMSSRGVKYVDCYGVDNVLVRVADPTFLGYFIEKGVSSAAKVVRKAYPQENVGVFVQRGRGGPLSVVEYSEMDAAMTTEINQSTGRLRYCWSNVCLHMFSLEFLNQVANSLEKDSVYHLAQKKIPSIHGYTMGLKLEQFIFDAFNYSPSTTLFEVLREEEFAPVKNANGSAYDTPDSAKLMLLRLHSRWVVAAGGFLTHSVPLYMTGVEVSPLSSYAGENLEAICRGRTFHAPSEISF

SEQ ID NO: 3888 - protein, 493 aa, Brachypodium distachyon
MKEMLVGSASPVGPVGRWGAAPPQALLERMKDYGQEGAFALWDELLPEERDLLVRDIESLDLSRIDRIIRRSLGSQGFLLPAIEPVPESSVSRVEERSPEDKERWWKRGLRAISEGKLAIVLLAGGQGTRLGSSDPKGCFNIGLPSGKSLFQLQAERILCVQKLAAQSSDTPGNILPIHWYIMTSPFTDDVTRKFFESRKYFGLEAEQVTFFQQGTLPCISADGRYIMETPYKVAKAPDGNGGVYSALKSKKLLEDMSARGVKYVDCYGVDNALVRVADPTFLGYFIEKGVSSAAKVVRKAYPQENVGVFVQRGRGGPLSVVEYSEMDAAMTTEINQSTGRLRYCWSNVCLHMFTLDFLNQVANSLEKDSVYHLAEKKIPSIHGCTMGLKLEQFIFDAFTYSPSTTLFEVSREEEFAPVKNANGATYDTPDSAKLMLLRLQSRWVVAAGGFLTHSVPLYMTGVEVSPLSSYAGENLEAICRGRTFHAPSEISF

SEQ ID NO: 3889 - protein, 493 aa, Oryza sativa
MKEIVVGSVAAAAAVGRWGAAPPQAMLERMKDYGQEGAFALWDELSPEDRELLVRDIESLDLSRIDRIIRRSLGSQGFTLPTVEPVPESSVSKVEERLPEDKERWWKKGLKAISEGKLAVVLLAGGQGTRLGSSDPKGCFSIGLPSGKSLFQLQAERILCVQKLAAQSSDSPNNTVPIHWYIMTSPFTDDITRKFFESRKYFGLEADQVTFFQQGTLPCVSADGRFIMETPYKVAKAPDGNGGVYAALKSRRLLEDMSSRGVKYVDCYGVDNALVRVADPTFLGYFIDKAVSSAAKVVRKAYPQENVGVFVRRGRGGPLSVVEYSEMDAAMATEINQSTGRLRYCWSNICLHMFTLDFLNQVANSLEKDSTYHLAEKKIPSIHGYAMGLKLEQYIFDAFSYSPSTALFEVLREEEFAPVKNANGASYDTPDSAKLMLLRLHSRWVVAAGGFLTHSVPLYMTGVEVSPLSSYAGENLEAICRGRTFHAPSEISF

SEQ ID NO: 3890 - protein, 491 aa, Oryza sativa
MKEIVVGSVAAAAAVGRWGAAPPQAMLERMKDYGQEGAFALWDELSPEDRELLVRDIESLDLSRIDRIIRRSLGSQGFTLPTVEPVPESSVSKVEERLPEDKERWWKKGLKAISEGKLAVVLLAGGQGTRLGSSDPKGCFSIGLPSGKSLFQLQAERILCVQKLAAQSSPNNTVPIHWYIMTSPFTDDITRKFFESRKYFGLEADQVTFFQQGTLPCVSADGRFIMETPYKVAKAPDGNGGVYAALKSRRLLEDMSSRGVKYVDCYGVDNALVRVADPTFLGYFIDKAVSSAAKVVRKAYPQENVGVFVRRGRGGPLSVVEYSEMDAAMATEINQSTGRLRYCWSNICLHMFTLDFLNQVANSLEKDSTYHLAEKKIPSIHGYAMGLKLEQYIFDAFSYSPSTALFEVLREEEFAPVKNANGASYDTPDSAKLMLLRLHSRWVVAAGGFLTHSVPLYMTGVEVSPLSSYAGENLEAICRGRTFHAPSEISF

SEQ ID NO: 3891 - protein, 493 aa, Setaria italica
MKEEMVVGLSAPGPVGRWGAAPPQALLERMKDYGQEGAFALWDDLSPEDRELLVRDIESIDLSRIDRIIRRSLGSQGMPLPAVEPVPESSVSKVEDRSPEDKERWWKKGLKAISEGKLAVVLLAGGQGTRLGSSDPKGCFNIGLPSGKSLFQLQAERILCVQKLAAQSSESPSNTVPIHWYIMTSPFTDAATRKFFETRRYFGLDADQVTFFQQGTLPCISADGRFIMETPYKVAKAPDGNGGVYAALKSKKLMEDMAARGVKYVDCYGVDNALVRVADPTFLGYFIDKGVSSAAKVVRKAYPQENVGVFVQRGRGGPLSVVEYSEMDAAMTTEINQSTGRLRYCWSNICLHMFTLDFLNQVANSLEKDSVYHLAEKKIPSIHGYTTGLKLEQFIFDAFTYSPSTALFEVMREEEFAPVKNANGATYDTPDSAKLMLLRLHSRWVVAAGGFLTHSVPLYMTGVEVSPLSSYAGENLEAICRGRTFHAPSEISF

SEQ ID NO: 3892 - protein, 493 aa, Panicum virgatum
MKEEMVVGLSAPGPVGRWGAAPPQALLERMKDYDQEGAFALWDDLSPEDRELLVRDIESIDLSRIDRIIRRSLGSQGMPLPAVEPVPESSVSKVEDRSPEDKERWWKKGLKAISEGKLAVVLLAGGQGTRLGSSDPKGCFNIGLPSGKSLFQLQAERILCVQKLAAQSSESPSNTMPIHWYIMTSPFTDAATRKFFETRRYFGLDADQVTFFQQGTLPCVSADGRFIMETPYRVAKAPDGNGGVYAALKSKKLMEDMAARGVKYVDCYGVDNALVRVADPTFLGYFIDKGVSSAAKVVRKAYPQENVGVFVQRGRGGPLSVVEYSEMDAAMTTEINQSTGRLRYCWSNICLHMFTLDFLNQVANSLEKDSVYHLAEKKIPSIHGYTTGLKLEQFIFDAFTYSPSTALFEVLREEEFAPVKNANGATYDTPDSVKLMLLRLHSRWVVAAGGFLTHSVPLYMTGVEVSPLSSYAGENLEAICRGRTFHAPSEISF

SEQ ID NO: 3893 - protein, 493 aa, Pennisetum glaucum
MKEEMVVGLSAPGPVGRWGAAPPQALLERMKDYGQEGAFALWDDLSPEDRELLVRDIASIDLSRIDRIIRRSLGSQGMPLPAVEPVPESSVSKVEDRSPEDKERWWKKGLKAISEGKLAVVLLAGGQGTRLGSSDPKGCFNIGLPSGKSLFQLQAERILCVQKLAAQSSESPSNTVPIHWYIMTSPFTDAATRKFFETRRYFGLDADQVTFFQQGTLPCISADGRFIMETPYQVAKAPDGNGGVYAALKSKKLMEDMAARGVKYVDCYGVDNALVRVADPTFLGYFIEKGVSSAAKVVRKAYPQENVGVFVQRGRGGPLSVVEYSEMDAAMTTEINQSTGRLRYCWSNICLHMFTLDFLNQVANSLEKDSVYHLAEKKIPSIHGYTTGLKLEQFIFDAFTYSPSTALFEVMREEEFAPVKNANGATYDTPDSSKLMLLRLHSRWVVAAGGFLTHSVPLYMTGVEVSPLSSYAGENLEAICRGRTFHAPSEISF

SEQ ID NO: 3894 - protein, 493 aa, Zea mays
MKEEMVVGLSAPGPVGRWGAAPPQAMLERMKDYGQEGAFALWDDLSPEDRELLVRDIESLDLSRIDRIIRRSLGSQGIPLPAVEPVPESSVSKVEDRSPEDKERWWKKGLKAISEGKLAVVLLAGGQGTRLGSSDPKGCFNIGLPSGKSLFQLQAERILCVQKLAAQSSESPSNTVLIHWYIMTSPFTDASTRKFFETRRYFGLDPDQVTFFQQGTLPCVSADGRFIMETPYRVAKAPDGNGGVYAALKSKKLMEDMAARGVKYVDCYGVDNALVRVADPTFLGYFIDKGVSSAAKVVRKAYPQENVGVFVQRGRGGPLSVVEYSEMDAAMTTEINQSTGRLRYCWSNICLHMFTLDFLNQVANSLEKDSVYHLAEKKIPSIHGFTTGLKLEQFIFDAFTYSPSTELFEVMREEEFAPVKNANGATYDTPDSAKLMLLRLHSRWVVAAGGFLTHSVPLYMTGVEVSPLSSYAGENLEAICRGRTFHAPSEISF

SEQ ID NO: 3895 - protein, 330 aa, Sorghum bicolor
MKEEMVVGLSAPGPVGRWGAAPPQAMLERMKDYGQEGAFALWDDLSPEDRELLVRDIESLDLSRIDRIIRRSLGSQGIPLPAVEPVPESSVSKVEDRSPEDKERWWKKGLKAISEGKLAVVLLAGGQGTRLGSSDPKGCFNIGLPSGKSLFQLQAERILCVQKLAAQSSESPSNTVPIHWYIMTSPFTDAVTRKFFETRRYFGLDPDQVTFFQQGTLPCVSADGRFIMETPYRVAKAPDGNGGVYAALKSKKLLEDMAARGVKYVDCYGVDNALVRVADPTFLGTSLTKVYLLLPKWLGRLIHKRMLGYLFNEVVVDLSRWLSTVKWMQL

SEQ ID NO: 3896 - protein, 493 aa, Saccharum officinarum
MKEEMVVGLSAPGPVGRWGAAPPQAMLERMKDYGQEGAFALWDDLSPEDRELLVRDIESLDLSRIDRIIRRSLGSQGIPLPAVEPVPESSVSKVEDRSPEEKERWWKKGLKAISEGKLAVVLLAGGQGTRLGSSDPKGCFNIGLPSGKSLFQLQAERILCVQKLASQSSESPSNTVPIHWYIMTSPFTDAATRKFFETRRYFGLDPEQVTFFQQGTLPCVSADGRFIMETPYRVAKAPDGNGGVYAALKSKKLLEDMAARGVKYVDCYGVDNALVRVADPTFLGYFIDKGVSSAAKVVRKAYPQENVGVFVQRGRGGPLSVVEYSEMDAAMTTEINQSTGRLRYCWSNICLHMFTLDFLNQVANSLEKDSVYHLAEKKIPSIHGFTTGLKLEQFIFDAFTYSPSTALFEVMREEEFAPVKNANGATYDTPDSAKLMLLRLHSRWVVAAGGFLTHSVPLYMTGVEVSPLSSYAGENLEAICRGRTFHAPSEISF

SEQ ID NO: 3897 - protein, 493 aa, Zea mays
MKEEMMVGLSAPEPVGRWGAAPPQAMLERMKDYGQEGAFALWDDLSPEDQELLVRDIESLDLSRIDRIIRRSLGSQGIPLPAVEPVPESSVSKVEGRSAEDKERWWKKGLKAISEGKLAVVLLAGGQGTRLGSSDPKGCFNIGLPSGKSLFQLQAERILCVQKLAAQSSESPSNTVPIHWYIMTSPFTDAATAKFFETRRYFGLDPDQVTFFQQGTLPCVSADGRFIMETPYRVAKAPDGNGGVYAALKSKKLMEDMAARGVKYVDCYGVDNALVRVADPTFLGYFIDKGASSAAKVVRKAYPQENVGVFVQRGRGGPLSVVEYSEMDAAMATEMNQSTGRLRYCWSNICLHMFTLDFLNQVANSLEKDSVYHLAEKKIPSIHGFTTGLKLEQFIFDAFTYSPSTALFEVMREEEFAPVKNASGATYDTPDSAKLMLLRLHSRWVVAAGGFLTHSVPLYMTGVEVSPLSSYAGENLEAICRGRTFHAPSEISF

SEQ ID NO: 3898 - protein, 489 aa, Oryza sativa
MAEIVVAPRAPAPAGRWGAAPPQELVERLKDYGQEGAFALWDELAPEERDFLVRDIESLDLARIDRIVRCSLRSQGVPLPAVEPVPESSVSTVEDRTPEDKQRWWKRGLKAISEGKLAVVLLAGGQGTRLGSSDPKGCFSIGLPSGKSLFQLQAERILCIQKLAAQSTDGTPQIHWYIMTSPFTDEATRKFFESHRYFGLEPDQVTFFQQGTIPCVSADGRFIMETPYKVARAPDGNGGVYAALKSQRLLDDMAGRGVKYVDCYGVDNVLVRVADPTFLGYFIDKGVSAAAKVVRKAYPQEKVGVFVQRGRGGPLSVVEYSEMDAAMTTEINQGTGRLRYCWSNVCLHMFTLDFLNQVTNSLEKDSIYHLAEKKIPSIHGYTAGLKLEQFIFDVFTYSPSTALFEILREEEFAPVKNANGATYDTPDSARLMLLRLHSRWVVAAGGFLTHSVPLYMTGVEVSPLSSYAGENLEAICRGRTFHAPSEISF

SEQ ID NO: 3899 - protein, 428 aa, Triticum aestivum
DRIIRRSMGSQGGYLAPAEPVPESSVSRVEERSPEDKERWWKKGLRAISEGKLAVVLLAGGQGTRLGSSDPKGCFSIGLPSGKSLFQLQAERILCIQKLAAQSSDSPRNTLPIHWYIMTSPFTDDVTRKFFESRKYFGLEADQVTFFQQGTLPCVSDDGRFIMETPYKVAKAPDGNGGVYAALKSKKLLDDMSSRGVKYVDCYGVDNVLVRVADPTFLGYFIEKGVSSAAKVVRKAYPQENVGVFVQRGRGGPLSVVEYSEMDAAMTTEINQSTGRLRYCWSNVCLHMFSLEFLNQVANSLEKDSVYHLAQKKIPSIHGYTMGLKLEQFIFDAFNYSPSTTLFEVLREEEFAPVKNANGSAYDTPDSAKLMLLRLHSRWVVAAGGFLTHSVPLYMTGVEVSPLSSYAGENLEAICRGRTFHAPSEISF

SEQ ID NO: 3900 - protein, 492 aa, Brachypodium distachyon
MAELVVAAAAPAPAGRWGAAPPQELLERLKDYGQEGAFALWDELAPEERDFLVRDIQSIDLARIDRIVRCSLRSQGGPVPVVQPVPESSVATVDDRSPEDKERWWRRGLKAIAEGKLAVVLLAGGQGTRLGSSDPKGCFSIGLPSGKSLFQLQAERILCVQKLAAQSTDAPGNTPQIHWYIMTSPFTDETTRKFFESRRYFGLEPDQVTFFQQGTLPCVSPDGRFIMETPYKVARAPDGNGGVYAALKSKRLLDDMSARGVKYIDCYGVDNVLVRVADPTFLGYFIDKGVSAAAKVVRKAYPQEKVGVFVQRGRGGPLSVVEYSEMDASMTTEINQTTGRLRYCWSNVCLHMFSLEFLNQVTNSLEKDSVYHLADKKIPSIHGYTAGLKLEQFIFDVFTYSPSTALFEVMREEEFAPVKNANGATYDTPDSARLMLLRLHSRWVVAAGGFLTHSVPLYMTGVEVSPMCSYAGENLEAICRGRTFHAPSEISL

SEQ ID NO: 3901 - protein, 493 aa, Setaria italica
MTEMVVAARAPAPAAGRWGAAPPQELLERLKDYGQEGAFAFWDELGPEERDHLIRDIESLDLPRIDRIVRCSLRSQGAPVPTVEPVPESSVSTVDDRTPEDKERWWRRGLRAISEGKLAVVLLAGGQGTRLGSSDPKGCFSIGLPSRKSLFQLQAERILCIQKLAAQCTDAPGSTVQIHWYIMTSPFTDEATRKFFETHRYFGLEPNQVTFFQQGTVPCVSPDGRFIMETPYKVAKAPDGNGGVYAALKSKKLLDDMAAKGVKYVDCYGVDNVLVRVADPTFLGYFIDRGVSAAAKVVRKAYPQEKVGVFVQRGRGGPLSVVEYSEMDAAMTTEINQTTGRLRYCWSNVCLHMFTLDFLNQVTNSLEKDSIYHLAEKRIPSVHGYTSGLKLEQFIFDVFNYSPSTALFEVLREEEFAPVKNANGATYDTPDSARLMLLRLHSRWVVAAGGFLTHSVPLYMTGVEVSPLCSYAGENLEAICRGRTFHAPSEISF

SEQ ID NO: 3902 - protein, 493 aa, Sorghum bicolor
MTEMVVAARAPAPAAGRWGAAPPQELLERLKDYGQEGAFAFWDELAPEERDHLIRDIESLDLPRIDRIVRCSLRSQGAPVPTFEPVPESSVSTVDDRTPEDKERWWRRGLRAISEGKLAVVLLAGGQGTRLGSSDPKGCFSIGLPSRKSLFQLQAERILCIQKLAAQCTDAPGSTVPIHWYIMTSPFTDEATRKFFETHRYFGLEPNQVTFFQQGTVPCVSHDGRFIMETPYKVAKAPDGNGGVYAALKSKRLLDDMAAKGVKYVDCYGVDNVLVRVADPTFLGYFIDRGASAAAKVVRKAYPQEKVGVFVQRGKGGPLSVVEYSEMDAAMTTEINQTTGRLRYCWSNVCLHMFTLDFLNQVTNSLEKDSIYHLAEKRIPSVHGYTSGLKLEQFIFDVFNYSPSTALFEVLREEEFAPVKNANGATYDTPDSARLMLLRLHSRWVVAAGGFLTHSVPLYMTGVEVSPLCSYAGENLEAICRGRTFHAPSEISF

SEQ ID NO: 3903 - protein, 493 aa, Zea mays
MTEMVVAARTPAPAAGRWGAAPPQELLERLKDYGQEGAFAFWDELAPEERDRLIRDIESLDLPRIDRIVRCSLRSQGAPIPTFEPVPESSVSTVDDRTPEDKERWWRRGLRAISEGKLAVVLLAGGQGTRLGSSDPKGCFSIGLPSRKSLFQLQAERILCIQKLAAQCTDAPGSTVQIHWYIMTSPFTDEVTRKFFETHRYFGLEPNQVTFFQQGTIPCVSHDGRFIMETPYKVAKAPDGNGGVYAALKSKRLLDDMAAKGVKYVDCYGVDNVLVRVADPTFLGYFIDRGVSAAAKVVRKAYPQEKVGVFVQRGKGGPLSVVEYSEMDAAMTTEINQTTGRLRYCWSNICLHMFTLDFLNQVTNSLEKDSIYHLAEKRIPSVHGYTSGLKLEQFIFDVFNYSPSTALFEVLREEEFAPVKNANGATYDTPDSARLMLLRLHSRWVVAAGGFLTHSVPLYMTGVEVSPLCSYAGENLEAICSGRTFHAPSEISF

SEQ ID NO: 3904 - protein, 465 aa, Sorghum bicolor
MKEEMVVGLSAPGPVGRWGAAPPQAMLERMKDYGQEGAFALWDDLSPEDRELLVRDIESLDLSRIDRIIRRSLGSQGIPLPAVEPVPESSVSKVEDRSPEDKERWWKKGLKAISEGKLAVVLLAGGQGTRLGSSDPKGCFNIGLPSGKSLFQLQAERILCVQKLAAQSSESPSNTVPIHWYIMTSPFTDAVTRKFFETRRYFGLDPDQVTFFQQGTLPCVSADGRFIMETPYRVAKAPDGNGGVYAGSSCRSYILRYFIDKGVSSAAKVVRKAYPQENVGVFVQRGRGGPLSVVEYSEMDAAMTTEINQSTGRLRYCWSNICLHMFTLDFLNQVANSLEKDSVYHLAEKKIPSIHGFTTGLKLEQFIFDAFTYSPSTALFEVMREEEFAPVKNANGTTYDTPDSAKLMLLRLHSRWVVAAGGFLTHSVPLYMTGVEVSPLSSYAGENLEAICRGRTFHAPSEISF

SEQ ID NO: 3905 - protein, 311 aa, Elaeis guineensis
MTSPFTDEATCKFFESHKYFGLEADQVTFFQQGTLPCVSGDGRFIMETPYKVARAPDGNGGLYAALRSSRLLEDMAMRGVKYVDVYGVDNALVRVADPAFLGYFIDKGVTAAAKVVRKAYPQEKVGVFVQRGRGGPLTVMEYSEMDPSMASEINQTTGRLRFCWSNICLHMFTLDFLNQVANGLEKDSIYHLAEKKIPSIHGYTIGLKLEQFIFDAFAYAPSTALFEVLREEEFAPVKNANGASYDTPDSARLMLLRLHSRWVVAAGGFLTHSVPLYLTGVEISPLCSYAGENLEAICRGRTFHAPCEIAF

SEQ ID NO: 3906 - protein, 491 aa, Musa acuminata
MKEIVVGSDVGRRGTPSPPPPPPQALLERLKDYGQEDAFAFWDELSPEERNLLVKDIESLDLPRIDRIIRCSLGSQGLPLPAVEPVPEASVSTVEARSLEERERWWKRGLKAISEGKLAVVLLSGGQGTRLGSSDPKGCFNIGLPSGKSLFQLQAERILCIQKLASQSNDTGFMPIHWYIMTSPFTDEATRKFFESHKYFGLESDQVTFFQQGTLPCVSGDGRFIMETPYKVSRAPDGNGGLYSALKSSKLLEDMAMRGVKYVDCYGVDNVLVRVADPAFLGYFIDKGVAAAAKVVRKAYPQEKVGIFVQRGRGGPFAVVEYSEMDASMTTEINQTTGRLRYCWSNVCLHMFTLDFLNQVANGLEKDSIYHLAEKKIPSIHGLTIGFKLEQFIFDAFAYAPSMALFEVPREEEFAPVKNANGASYDTPDSARLMLLRLHSRWVVAAGGFLTHSVPLYLTGVEISPLCSYAGENLEAICRGRTFHAPSEITI

SEQ ID NO: 3907 - protein, 488 aa, Musa acuminata
MTEMVVGSEVGRRGTPSPPPPPQALLERLKDYGQEDAFALWDELSPEERDLLVKDIESLDLPRVDRIIRCSLGSQGAYLPAVEPVPESSVSTVEVRTLEDRERWWKRGLKAISEGKLAVVLLSGGQGTRLGSSDPKGCFNIGLPSGKSLFQIQAERILRLQRLAAQSNDAGFVPPIPWYIMTSPFTDEATRRFFERHKNFGLEVDQVTFFQQGTLPCVSSDGRFIMETPYKVSKAPDGNGGLYSALKLSKLLEDMAMRGVRYVDCYGVDNALVRVADPTFLGYFIDKGVATAAKVAYPQEKVGVFVQRGRGGPLTVVEYSEMDASMTTEINQSTGRLRYCWSNVCLHMFTLDFLNQVANGLEKDSIYHLAEKKIPSIHGYTMGLKLEQFVFDAFTYAPSMALFEVLREEEFAPVKNANGASYDTPDSARLMLLRLHSRWVVAAGGFLTHSVPLYLTGVEISPLCSYAGENLEGLCRGRTFHAPCEISF

SEQ ID NO: 3908 - protein, 162 aa, Leymus cinereus x Leymus triticoides
MATANLSSVVVAVDGSEESMKALRWALDSLRLRPDGALVVLHVQPPPGIAAGLNPGPIPFGGPSVAEVPAFTQAIEAHQRRITEAILEHALKICSDKNVEVKTQVAVGDPKEKICEVTAELKADLLVMGCRAFGPVKRMFLGSVSNYCINSVGCPVVVIKGT

SEQ ID NO: 3909 - protein, 162 aa, Pseudoroegneria spicata
  misc_feature (95)..(95): Xaa can be any naturally occurring amino acid
MATANLSSVVVAVDGSEESMKALRWALDSLRLRPDGALVVLHVQPPPGIAAGLNPGPIPFGGPSVAEVPAFTQAIESHQRRITEAILEHALKICXGKNVEVKTQVVVGDPKEKICEVTAELKADLLVMGCRAFGPVKRMFLGSVSNYCINSVGCPVVVIKGT

SEQ ID NO: 3910 - protein, 197 aa, Secale cereale
MATANLSSVVVAVDGSEESMKALRWALDSLRLRPDGALVVLHVQPSPGIAAGLNPGPIPFGGPSVAEVPAFTQAIEAHQRRITDAILEHALKICSDKNVEVKTQVVVGGSQGEDLRGDGRTQGRSARHGVPCFWPCQEDVLGQREQLLHQQRWLPRRGNQGHLTYHQPNIRSCAVCNPVETTALYVCSCCLLGCAER

SEQ ID NO: 3911 - protein, 162 aa, Secale cereale
MATANLSSVVVAVDGSEESMKALRWALDSLRLRPDGALVVLHVQPSPGIAAGLNPGPIPFGGPSVAEVPAFTQAIEAHQRRITDAILEHALKICSDKNVEVKTQVVVGDPKEKICEVTAELKADLLVMGCRAFGPVKRMFLGSVSNYCINSVGCPVVVIKGT

SEQ ID NO: 3912 - protein, 162 aa, Triticum aestivum
MATASLSSVVVAVDGSEESMKALRWALDSLRLRPDGALVVLHVQPPPGIAAGLNPGPIPFGGPSVAEVPAFTQAIESHQRRITDAILEHALKICSDKNVEVKTQVVVGDPKEKICEVAAELKADLLVMGCRAFGPVKRMFLGSVSNYCINSVGCPVVVIKGT

SEQ ID NO: 3913 - protein, 162 aa, Triticum aestivum
MATANLSSVVVAVDGSEESMKALRWALDSLRLCPDGALVVLHVQPPPGIAAGLNPGPIPFGGPSVAEVPAFTQAIESHQRRITDAILEHALKICSDKNVEVKTQVVVGDPKEKICEVAAELKADLLVMGCRAFGPVKRMFLGSVSNYCINSVGCPVVVIKGT

SEQ ID NO: 3914 - protein, 162 aa, Secale cereale
MATANLSSVVVAVDGSEESMKALRWALDSLRLRPDGALVVLHVQPSPGIAAGLNPGPIPFGGPSVAEVPAFTQAIEAHQRRITDAILEHALKICSEKNVEVKTQVVVGDPKEKICEVTAELKADLLVMGCRAFGPVKRMFLGSVSNYCINSVGCPVVVIKGT

SEQ ID NO: 3915 - protein, 158 aa, Secale cereale
NLSSVVVAVDGSEESMKALRWALDSLRLRPDGALVVLHVQPSPGIAAGLNPGPIPFGGPSVAEVPAFTQAIEAHQRRITDAILEHALKICSDKNVEVKTQVVVGDPKEKICEVTAELKADLLVMGCRAFGPVKRMFLGSVSNYCINSVGCPVVVIKGT

SEQ ID NO: 3916 - protein, 164 aa, Brachypodium distachyon
MATGGGNLGSVVVAVDGSEESMKALRWALDSVRLRPDGALVVLHVQPRPGIAAGLNPGPIPFGGPREVEVPAFTQAIEAHQRRITEAILEHALKICAEKNVEVKTEVVVGDPKEKICEVAAELKADLLVMGSRAIGPVKRMFLGSVSNYCINSVGCPVVVIKGT

SEQ ID NO: 3917 - protein, 162 aa, Oryza sativa
MATGNLASVVVAVDGSEESMNALRWALDNLRLRPDGALVVLHVQPPPSIAAGLNPGPIPFGGPSEVEVPAFTQAIEAHQRRITQAILDHALKICSEKNVEVKTDVVVGDPKEKICEVTANLKADLLVMGCRAFGPLKRMFLGSVSNYCINNVVCPVVVIKGT

SEQ ID NO: 3918 - protein, 162 aa, Sorghum bicolor
MATGNLASVVVAVDGSEESMNALRWALDNLRLRPDGELVVLHVQPPPNIAAGLNPAPIPFGGPSGVEVPAFTQAIEAHQRRITQAILEHALKICSEKNVEVKTEVVVGDPKEKICEVAANSKADLLVMGCRAIGPLKRVFLGSVSNYCINHVGCPVVVIKGT

SEQ ID NO: 3919 - protein, 168 aa, Avena sativa
LTKRQPWPPGNLGSVVVAVDGSEESMNALRWALDSLRLRPDGALVVLHVQPPPGIAAGLNPGPIPFGGPKGVEVPAFTQAIEAHQRRITDAILEHALKICADKIVEVKTKVVVGDPKEKICEVAAELKADLLVMGCRAFGPVKRMFLGSVSNYCINSVGCPVVVIKGT

SEQ ID NO: 3920 - protein, 162 aa, Saccharum officinarum
MATGNLASVVVAVDGSEESMNALRWALDNLRLRPDGELVVLHVQPPPNIAAGLNPAPIPFGGPSGVEVPAFTQAIEAHQRRITQAILEHALKICSEKNMEVKTEVVVGDPKEKICEVAANRKADLLVMGCRAIGPLKRVFLGSVSNYCINHVGCPVVVIKGT

SEQ ID NO: 3921 - protein, 162 aa, Setaria italica
MATGNLASVVVAVDGSEESMNALRWALDNLRLRPDGELVVLHVQPPPNIAAGLNPAPIPFGGPSGLEVPAFTQAIEAHQRRITQAILEHALKICSAKNVEVKTEVIVGDPKEKICEATANRNADLLVMGCRAIGPLQRMFLGSVSNYCINHVGCPVVVIKGT

SEQ ID NO: 3922 - protein, 162 aa, Zea mays
MATGNLASVVVAVDGSEESMNALQWALDNLRLRPDGELVVLHVQPLPNIAAGLNPAPIPFGGPSGLEVPAFTQAIEAHQRRITQAILEHALKICSDKNVEVKTEVVVGDPKDKICEIAANRKADLLVMGCRAIGPLKRVFLGSVSNYCINHVGCPVVVIKGT

SEQ ID NO: 3923 - protein, 162 aa, Pennisetum glaucum
MATGNLASVVVAVDGSEESMNALRWALDNLRLRPDGELVVLHVQPLPNIAAGLNPAPIPFGGPSGLEVPAFTQAIEAHQRRITQVILEHALKICSDKNVEVKTEVIVGDPKEKICEATANHNADLLVMGCRAIGPLQRMFLGSVSNYCINHVGCPVVVIKGT

SEQ ID NO: 3924 - protein, 162 aa, Cynodon dactylon
MATGNLASVVVAVDGSEESMNALRWALDNLRLRPDGELLVLHVQPPPSIAAGLNPAPIPFGGPSEVEVPAFTQAIEAHQRRITQAILDHAHKICSEKNEEVKTEVVVGDPKEKICEVTANCKADLLVMGCRAIGPLQRMFLGSVSNYCINHVGCPVIVIKGT

SEQ ID NO: 3925 - protein, 162 aa, Panicum virgatum
MATGNLGSVVVSVDGSEESMNALRWALDNLRLRPDGEFAVLHVQPPPNIAAGLNPAPIPFGGPSGLEVPAFTQAIEAHQRRITQAILEHALEICSEKNVEVKTEVIVGDPKEKICEVTANRNADLLVMGCRAIGPLKRMFLGSVSNYCINHVGCPVVVIKGT

SEQ ID NO: 3926 - protein, 164 aa, Panicum virgatum
MATGNLASVVVSVDGSEESMNALRWALDNLRLRPRPDGEFVVLHVQPPPNIAAGLNPAPIPFGGPSGLEVPAFTQAIEAHQRRITQAILEHALKICSEKHVEVKTEVIVGDPKEKICEVTANRNADLLVMGCRAIGPLKRMFLGSVSNYCINHVGCPVVVIKGT

SEQ ID NO: 3927 - protein, 235 aa, Secale cereale
MAASLRSPPPVPAAAAAFRRSRAAVVVCASSSSSSSSSSAVSSAPKARFVARRSESTSVQQLARPLAEYMGLPASQYSVLDAERIERVDESTFRCYVYRFRFFALEVCPVLLVRVDEEPNGCCIRLLSCKLEGSPLVEAQNDKFSASMVNRVFCSSSSEDSSLQQLTSDATIEVAIDIPFPFQALPVEAIESSGRQVLEQLLRVMLPRFLKQLDKDYQAWASGDSSRKPLGTGEI

SEQ ID NO: 3928 - protein, 231 aa, Pseudoroegneria spicata
MAASLRSPPPVPATAFRRSRAAVVCASSSSSSSSSAVSSAPKARFVARRSESTSVRQLARPLAEYMGLPASQYSVLDAERIERVDESTFRCYVYRFRFFALEVCPVLLVRVDEEPNGCCIRLLSCKLEGSPLVEAQNDKFSASMVNRVFCNNSSDDSTLQQLTSDATIEVAIDIPFPFQALPVEAIESSGRQVLEQLLRVMLPRFLKQLDKDYQAWASGDSSRKPLGTGEI

SEQ ID NO: 3929 - protein, 234 aa, Triticum aestivum
MAASLRSPPPVPAAAAFRRCRAAAVVCASSSPSSSSSSAVSSAPKARFVARRSESTSVQQLARPLAEYMGLPASQYSVLDAERIERVDESTFRCYVYRFRFFALEVCPVLLVRVDEEPNGCCIRLLSCKLEGSPLVEAQNDKFSASMVNRVFCNSSSEGSTLQQLTSDATIEVAIDIPFPFQALPVEAIESSGRQVLEQLLRVMLPRFLKQLDKDYQAWASGDSSRKPLGTGEI

SEQ ID NO: 3930 - protein, 231 aa, Avena sativa
MAASLRSPPPVASPFRRSRAVVVCASSSSSSSSSAVSSSAPKARFVARRSESASVRQLARPLAEYMGLPASQYSVLDAERIERVDESTFRCYVYRFRFFALEVCPVLLVRVDEEPNGCCIRLLSCKLEGSPLVEAQNDKFSASMVNKVFCNNSSDGSALQQLTSDATIEVTIDIPFPFQALPVEAIESSGRQVLEQLLRAMLPRFLKQLDKDYQAWASGDSSRKPLGTGEI

SEQ ID NO: 3931 - protein, 232 aa, Brachypodium distachyon
MAASLRSPPPVPASAFRRSRPGAAVVRASSSSSSSSSTAVSSAPKARFVARRSESTSVQQLARPLAEYMGLPASQYSVLDAERIERVDDSTFRCYVYRFRFFALEVCPVLLVRVDEEPNGCCIRLLSCKLEGSPLVEAQNDKFSASMANRVFCNNSSDGSQQLTSDATIEVTIDIPFPFRAIPVEAIESSGRQVLEQLLRVMLPRFLKQLDKDYQAWASGDSSRKPLGTGEI

SEQ ID NO: 3932 - protein, 230 aa, Oryza sativa
MAASLRSPPPFPAAAFRRRRAVVRASSSSSSSSSAVSSAPKARFVARRSESTFVQQLARPLAEYMSLPASQYSVLDAERIERVDESTFRCYVYRFRFFALEVCPVLLVRVDEEPNGCCISLLSCKLEGSPLVEAQNDKFSASMVNKVFCNSSMSDSTSQQLTSDTTIEVTIDIPFPFRALPVEAIESSGKQVLEQLLRVMLPRFLKQLVKDYQAWASGDSSRKPLGTGEI

SEQ ID NO: 3933 - protein, 233 aa, Sorghum bicolor
MAASLRSPPPLAAAFRRSRVVVRASSSSSSSSSSAVSSSSSAPKARFVARRSESVPVQQLARPLAEYMSLPASQYSVLDAERIERVDDSTFRCYVYRFRFFALEVCPVLLVRVDEEPDGCCIRLLSCKLEGSPLVEAQNDKFSASMANRVFCSSRSQDSTIQQLTSDTTIEVAIDIPFPFRAIPVEAIESSGRQVLEQLLRVMLPRFLKQLVKDYQAWASGDASRKPLGTGEI

SEQ ID NO: 3934 - protein, 233 aa, Setaria italica
MAASLRSPPPVPAAFRRSRAVVRASSQSSSSSSSAVSSSSSAPKARFVARRSESVSVQQLARPLAEYMSLPASQYSVLDAERIERVDDSTFRCYVYRFRFFALEVCPVLLVRVDEEPNGCCIRLLSCKLEGSPLVEAQNDKFSASMVNRVFCSSTLQGSTLQQLTSDTTIEVTIDIPFPFRAIPVTAIESSGRQVLEQLLGVMLPRFLNQLVKDYQAWASGDSSRKPLGTGEI

SEQ ID NO: 3935 - protein, 231 aa, Zea mays
MAASLCSPPPLPSAFRRSRAVVRASSSSSSSSAVSSSSSAPKARFVARRSESVPVQQLVRPLAEYMSLPASQYSVLDAERIERVDDSTFRCYVYRFRFFALEVCPVLLVRVDEEPNGCCIHLLSCKLEGSPLVEAQNDKFSASMANRVFCSSKSQDSTLQQLTSDTTIEVAIDIPFPFRAIPVEAIESSGRQVLEQLLRVMLPRFLKQLVKDYQAWASGDASRKPLGTGEI

SEQ ID NO: 3936 - protein, 522 aa, Secale cereale
TRLPVLSSRRDNRLTKQRPWRRRWGIKRAPAAQAVTVQPPPDARLVREAVRTSTIAEAVAPAALEAPAPALEGFLCLEEVEGRRWKYVVDAAPGKGKARGRGRGGSAVPLGASVRAVPLQSPLPPAEEIMAFVRSYVVPEGFPDSVTPSYVPYMTWRALKHFFGGAMGVFTTRTLLSSVGVSQSKVTPGAIAINWILKDGAGRVGKMLFARQGKKFDNDLKQLRFSSDLLLEIGAGIELATAAFPQFFLPMACVANVVKNVAAVTSTSTRTPIYKAYARGENIGDVTAKGESVGNIADLLGTGLSIFITKRNPSLVTSFALLSCGYLLSSYHEVRSVVLNTLNRARFTVAVDSFIKTGYVPSLKEGNSQETIFIHPWRHEPVSIGSRFGEAFQEPVSFVATRPLFEDERYMVTYNPTKDKVYALLKDQAKPDDILKAAFHAHVLLHFINVSHERKRMSSNRSDYYGNPHPRNMDFLAHIAESCKIVSSSYGTFRKKAKEQGWIMSESLLNPGKARLCVTRPQ

SEQ ID NO: 3937 - protein, 504 aa, Avena sativa
MAPAVGIKRSPAATQTVTAPPPSPPDARFALGAAVKSTIVDPTPGDRLDAPAPAVEGFLCLEEIEGRRWKYVVDGHAGNKRKGRRGGSAVPPGASVRAVPLQSPLPPAEEIMAFVRSYVVPEGFPDSVTPSYVPYMTWRALKHFFGGAMGVFTTRTLLSSVGVSQSKVTPGAIAINWILKDGAGRVGKMLFARQGKKFDNDLKQLRFSSDLLLEIGAGIELATAAFPQFFLPMACVANVVKNVAAVTSTSTRTPIYKAYSRGENIGDVTAKGESVGNIADLLGTGLSIFITKRNPSLVTSFALLSCGYLLSSYHEVRSVVLNTLNRARFTVAVDSFIKTGYVPTLKEGNSQETIFIHPWRHEPVEIGSRFGEAFQEPVSFVATRPLFEDERYMVTYNPTKDKVYALLKDQAKPDDILKAAFHAHVLLHFINKTHERKRMSSNRSDHYGNLHQRNVDFLPHIAESSKIVSSSYGTFRKKAKEQGWIMSESLLNPGKARLSVTRPQ

SEQ ID NO: 3938 - protein, 356 aa, Triticum aestivum
MGVFTTRTLLSSVGVSQSKVTPGAIAINWILKDGAGRVGKMLFARQGKKFDNDLKQLRFSSDLLLEIGAGIELATAAFPQFFLPMACVANVVKNVAAVTSTSTRTPIYKAYARGENIGDVNAKGESVGNIADLLGTGLSIFITKRNPSLVTSFALLSCGYLLSSYHEVRSVVLNTLNRARFTVAVDSFIKTGYVPSLKEGNSQETIFIHPWRHEPVSIGSRFGEAFQEPVSFVATRPLFEDERYMVTYNPTKDKVYALLKDQAKPDDILKAAFHAHVLLHFINVSHERKRMSSNRSDHYGNPHPRNMDFLAHIAESCKIVSSSYGTFRKKAKEQGWIMSESLLNPGKARLCVTRPQ

SEQ ID NO: 3939 - protein, 349 aa, Pseudoroegneria spicata
MATSGDQSGGCGSAAAKGSKLRYPLRSAGRGKLEPAAADAPPSGPASRRAKPSSDVTKSCALDLSAVKDKSAKPPRRHSIPTKPGVSPRPTPTGTITPVSGVRSRRSDSLGRLDTPTSEASMSTARRKFSTLSSVSYWMTQIRLAEAASKHSISLGFFKLALESECEPLDRMREELKAYVARHGLATELEEPVKEILQVYDIVEDFEKLKISLDSSLEPKKSDKAALSATNVTPKGNLKPRSLNSVATQSKDGKKENIQKEKPDAKIRGSYNQNPAKNAPAKGAKNTSKKTKKQAKEQQEDCNGGSEVSPVDADQESVDVVKEITYEDKENMGDAEMAIDAGNSVAQEV

SEQ ID NO: 3940 - protein, 351 aa, Triticum aestivum
MATSGDQSGGCGSAAAKGSKLRYPLRSAGRGKLEPPAAADAAPSGPASRRAKPSSDVTKSCALDLSAVKDKSAKPPRRHSIPTKPGVSPRPTPTGTITPVSGVRSRRSDSLGRLDTPTSEASMSTARRKFSTLSSVSYWMTQIRLAEAASKHSISLGFFKLALESECEPLDRMREELKTYVARHGLATELEEPVKEVLQVYDIVEDFEKLKISLDSSQEPKKSDKVALSAANVTPKGNLKPRSLNSVATQSKDGKKENSQKEKPDAKIRGSYNRNPAKNAPAKEAAKNTIKKTKKQAKEQQEDCNGGSDVSPVDADQESVDAVKEITYEDKENMGDAEMAIDAGNTIAQEV

SEQ ID NO: 3941 - protein, 351 aa, Secale cereale
MATSGDQSAGCVSAGTKGSKLRYPLRSAGRGKLEPAAAGEAPPSGPASRRAKPSSDVTKSCVLDLSAVKDKSAKPPRRHSIPTKPGVSPRPTPTGIITPVSGVRSRRSDSLGRLGTPTSEASMSTARRKFSTLSSVSYWMTQIRLAEAASKHSISLGFFKLALESECEPLDRMREELKTYVARHGLATELEEPVKEILQVYDIVEDFEKLKISLDSSQEPKKSDKASLGAANVTPKGNLKPRSLNSVATQSKDGKKENIQKEKPDAKIRGSYNRNPAKNAPAKEGAKNTAKKTKKQAKEQQEDCNGGSEVSPVDGDQESVDVVKEITYEDKENMGDAEMAIDAGNAVAQEV

SEQ ID NO: 3942 - protein, 351 aa, Secale cereale
MATSGDQSAGCVSAATKGSKLRYPLRSAGRGKLDPAAAGEAPPSGPASRRAKPSSDVTKSCVLDLSAVKDKSAKPPRRHSIPTKPGVSPRPAPTGTITPVSGVRSRRSDSLGRLGTPTSEASMSTARRKFSTLSSVSYWMTQIRLAEAASKHSISLGFFKLALESECEPLDRMREELKTYVARHGLATELEEPVKEILQVYDIVEDFEKLKISLDFSQEPKKSDKASLGAANVTPKGNLKPRSLNSVATQSKDGKKENIQKEKPDAKIRGSYNRNPAKNALAKEGAKNTAKKTKKQAKEQQEDCNGGSEVSPVDADQESVDVVKEITYEDKENMGDAEMAIDAGNAVAQEV

SEQ ID NO: 3943 - protein, 350 aa, Avena sativa
MATPGDQSGSAAAKGSKLRYPLRSASRGKVEPAPLADAPPSGSVPRRAKPSSDVTKSMCALDLSSVKDKSAKPPRRHSIPTKPGASPRPTPSGTITPVSGVRSRRSDTLGKLDTPTSEASMSTARRKFSTLSSISYWMTQIRLAEAASKHSISLGFFKLALESECEPLDRMREELKAYVARHGLTTELEEPVKDILQVYDIADDFEKLKISVESSQDPKKSDKAAPSATNVTPKGNLKPRSLNSVATQNKDGKKENIQKEKPDSKVRGSYNRNPAKNAPGKETAAKNGVKKTKKQAKEQQEDGNGGSEALSVGSEQASVDVVMEITYEDKENMGDTEMARDAGNGIAQEV

SEQ ID NO: 3944 - protein, 350 aa, Brachypodium distachyon
MATSGDQSGSAAAKASKLRYPLRSASRGKAAPLAVDAPPADSAPRRAKPSSDVTKSMCVLDLSSVKDKSAKPPRRHSIPTKPGASPRPTTTTGTITPVSVVRSRRSEIQGKFDTPTSEASMSTGRRKFSTLSSISYWMTQIRLAEAASKHSVSLGFFKLALESECEPLDRMREELKAYIARHGLATDLEEPVKDILQVYDIAGDFEKLKISVDSSLESKKCDKAALSATNATPKGNLKPRSLNSVATQSKDGKKENIQKEKPDAKVRGSYTRNPAKVAPGKELAAKNTGKKTKKQAKEHQEDCNGGSEALPVDPDLESVDVVKEITYEDKENMGDTEMSIDGGNGLAQEV

SEQ ID NO: 3945 - protein, 229 aa, Triticum aestivum
MSTARRKFSTLSSVSYWMTQIRLAEAASKHSISLCFFKLALESECEPLDRMREELKAYVARHGLATELEEPVKEILQVYDIVEDFEKLKISLDSSQEPKKSDKSAVSAANVTPKGNLKPRSLNSVATQSKDGKKENIQKEKPDAKIRGSYNKNPAKNAPAKEGAKNTVKKTKKQAKEQQEDCNGGSEVSPVEADQESVDVVKEITYEDKENMGDAEMAIDAGNAVAQEV

SEQ ID NO: 3946 - protein, 302 aa, Triticum aestivum
RAKPSSDVTKSCALDLSAVKDKSAKPPRRHSIPTKPGVSPRPTPTGTITPVSGVRSRRSDSLGRCDTPTSEASMSTARRKFSTLSSVSYWMTQIRLAEAASKHSISLCFFKLALESECEPLDRMREELKAYVARHGLATELEEPVKEILQVYDIVEDFEKLKISLDSSQEPKKSDKSAVSAANVTPKGNLKPRSLNSVATQSKDGKKENIQKEKPDAKIRGSYNKNPAKNAPAKEGAKNTVKKTKKQAKEQQEDCNGGSEVSPVEADQESVDVVKEITYEDKENMGDAEMAIDAGNAVAQEV

SEQ ID NO: 3947 - protein, 302 aa, Secale cereale
RAKPSSDVTKSCVLDLSAVKDKSAKPPRRHSIPTKPGVSPRPAPTGTITPVSGVRSRRSDSLGRLGTPTSEASMSTARRKFSTLSSVSYWMTQIRLAEAASKHSISLGFFKLALESECEPLDRMREELKTYVARHGLATELEEPVKEILQVYDIVEDFEKLKISLDSSQEPKKSDKAALGAANVTPKGNLKPRSLNSVATQSKDGKKENIQKEKPDAKIRGSYNRNPAKNAPAKEGAKNTAKKTKKQAKEQQDDCNGGSEVSPVDADQESVDVVKEITYEDKENMGDAEMAIDAGNAVAQEV

SEQ ID NO: 3948 - protein, 302 aa, Triticum aestivum
RAKPSSDVTKSCALDLSAVKDKSAKPPRRHSIPTKPGVSPRPTPTGTITPVSGVRSRRSDSLGRLDTPTSEASMSTARRKFSTLSSVSYWMTQIRLAEAASKHSISLGFFKLALESECEPLDRMREELKTYVARHGLATELEEPVKEILQVYDIMEDFEKLKISLDSSLEPKKSDKAALGAANVTPKGNLKPRSLNSVATQSKDGKKENIQKEKPDAKIRGSYNRNPAKNAPAKEVAKNTAKKTKKQAKEQQEDCNGGSEVLPVDADQESVDVVKEITYEDKENMGDAEMAIDAGNAIAQEV

SEQ ID NO: 3949 - protein, 199 aa, Triticum aestivum
MAPHAAVLLSLLLLTTCAADTHLHFFLHDVVSGSNPTAVQVIKGPASSSNALPDVAFGDTTVIDDALTETSSPTSAPVGRAQGFYMMSSQSGMVLMMCVNLLLTTGDYNGSTLAVIGRDDVMTTTRELSVVGGTGKFRMATGYVVWKTNSSSGADATIELDVYTTGLNGTATIDANAPVSPIDGGGAGAPASRPRARRR

SEQ ID NO: 3950 - protein, 224 aa, Triticum aestivum
APHAAVLLSLLLLTTCAADTHLHFFLHDVVSGSNPTAVQVIKGPASSSNALPDVAFGDTTVIDDALTETSSPTSAPVGRAQGFYMMSSQSGMVLMMCVNLLLTTGDYNGSTLAVIGRDDVMTTTRELSVVGGTGKFRMATGYVVWKTNSSSGADATIELDVYTTGLNGTATIDANAPVSPIDGGGAGATGKSSSGAAALRGAVRYGWANAWVAAVLVALAGCVW

SEQ ID NO: 3951 - protein, 225 aa, Secale cereale
MASHAAVLFSLLLLTTCAADTHLHFFLHDVVSGSNPTAVQVIKGPASSSNALPGVAFGDTTVIDDALTETSSPTSAPVGRAQGFYMMSSQSGMVLMMCVNLLLTTGDYNGSTLAVIGRDDVMTTTRELSVVGGTGKFRMATGYVLWKTNSSSGADATIELDVYTTGINGTATIDANAPVSPIDGGGAGASGGATGKSSSGAAALRGAVPYGWVAAVLVALAGCVW

SEQ ID NO: 3952 - protein, 260 aa, Secale cereale
TGADATAEPFRIYVGYDSREDIAYRVCRRSLLRRSSVPLEVIPIVQQELREAGLYWRERGPTESTEFSFTRFLTPHLAGYRGWALFVDCDFLFVADVAELARMADPRYAVLCVHHDYTPKEATKMDGAVQTVYPRKNWSSMVLFNCGHPKNRAALTPEAVSTQSGAHLHRFAWLDDADVGEVPFAWNFLVGHNRVDPADVAGTTPRAIHYTSGGPWFERYKDCEFADLWVQERDAYESEEKQDEVEGTRVPSSSTVAVDA

SEQ ID NO: 3953 - protein, 279 aa, Setaria italica
MSPTPSHLAGAGAVAVAGPEPFRVFVGYDSREDIAYRVCRRSLLRRSSIPLDVIPIVQQELREAGLYWRERGPTESTEFSFTRFLTPHLAGYRGWALFVDCDFLFVADVADLARLAASADPRHAVLCVHHDYTPTEATKMDGAVQTVYPRKNWSSMVLFNCGHSKNRAALTPEAVSTRSGAYLHRFMWLDDDEVGEVPFVWNFLVGHNKVDPADEAATAPRAIHYTSGGPWFERYKDCEFADLWVQERDAYEAEEEKKKVEEEGVKAAVQMSSAVSVDA

SEQ ID NO: 3954 - protein, 285 aa, Oryza sativa
MSVTPTNDVVMTGPVAGAGDVQAAETFRVFVGYDSREDIAYRVCRRSLLQRSSVPVAVIPIVQQELRSAGLYWRERGPTESTEFSFTRFLTPHLAGYRGWALFVDCDFLFVADVAELARMADPRYAVLCVHHDYAPKEATKMDGAVQTVYPRKNWSSMVLFNCAHPKNRAALTPEAVSTQSGAYLHRFMWLDDADIGEVPFVWNFLVGHNRVDPADTAGTAPRAIHYTSGGPWFEQYKNCEFAELWVQERDAYEAEAEEDEEKEEHEPKAILHAPAAPSAVPVDA

SEQ ID NO: 3955 - protein, 82 aa, Secale cereale
MMWGVAAAVASAAAVAVASGAELLACDCAPTPAVAVGRCDEFLLRQRDSSASSGASGGVPDDKFAPRFDGLRFIETLVTAHR

SEQ ID NO: 3956 - protein, 82 aa, Triticum aestivum
MMWGVAAAVASAAAVAVASGAELLACDCAPTEPPAAVAIGRCDEFLLRQRDSSASSGASGDDKFAPRFDGLRFIETLVTAHR

SEQ ID NO: 3957 - protein, 106 aa, Secale cereale
PSPLVPTSSRQSPEEEGKAAAGSTMMWGVAAAVASAAAVAVASGAELLACDCAPTPAVAVGRCDEFLLRQRDSSASSGASGGVPDDKFAPRFDGLRFIETLVTAHR

SEQ ID NO: 3958 - protein, 82 aa, Secale cereale
MMWGVAAAVASAAAVAVASGAELLACDCAPTPAVAVGRCDEILLRQRDSSASSGASGGGPDDKFAPRFDGLRFIETLVTAHR

SEQ ID NO: 3959 - protein, 82 aa, Triticum aestivum
MMWGVAAAVASEDAVAVASGAELLACDCAPTEPPAAVAIGRCDEFLLRQRDSSASSGASGDDKFAPRFDGLRFIETLVTAHR

SEQ ID NO: 3960 - protein, 79 aa, Triticum aestivum
MMWGIATAVASAAAVAVASGAELLACDCAPTAPTAAVVGRCDGFLFRQRESSSSSGRGERFAPRFDGLRFIETLVTAHR

SEQ ID NO: 3961 - protein, 82 aa, Hordeum vulgare
MMWGLAAAVASAAAVAVASGAELLACEDRAPTAPATALAVVGRCDRFLLRQQGSSSSGGRDDRFAPRFDGLRFIETLVTAHR

SEQ ID NO: 3962 - protein, 558 aa, Triticum aestivum
MGEMNHQPGAPPPVGVPPPMGMQPMMNAPVGAGAMHQPYEQFNQLNYCVHSNPSWVQVAGLAFLHYLVMLGSTVMLVSIIVPAMGGGPGEKARVIQAFLFVSGINTLLQTLVGTRLPTVMNASFAFVVPVLSIARQFNTNDFESNHERFVHTMRATQGALIVASILNMILGYSRAWGAFAKKFSPVIMTPVVCVVGLGLFQIGFPQVGKCVEIGLPMLILAIVVQQYAPLYFRHIHDRTTFLFERYSLLLCIGIVWAFAAILTAAGAYNHVSLKTQQHCRTDKSFLISSAPWIKISYPFHWGPPIFTAGHSFGMMGAVLVSSFESTGAHFATARLAGATPPPAHVLTRSIGLQGIGIFLAGLCGAPAGSSVSVENIGLLGLTKVGSRRVIQISTGFMIFFSIFGKFGAFFASIPLPIFAAIYCILFGIVAAVGISFSQFANKNSMRNIYIIGLSLFLGISIPQYFAEYTASAGRGPARTNAGWFNDIINTVFASGPTVALIVASLLDNTLEPRANENDRGLSWFTPFLRRRKGYSDPRNEEFYSYPIRVHDLVPHRFL

SEQ ID NO: 3963 - protein, 558 aa, Triticum aestivum
MGEMNHQPGVPPPVGVPPPMGMQPMMNAPVGAGAMHQPYEQFNQLNYCVHSNPSWVQVAGLAFLHYLVMLGSTVMLVSIIVPAMGGGPGEKARVIQAFLFVSGINTLLQTLVGTRLPTVMNASFAFVVPVLSIARQFNTNDFESNHERFVHTMRATQGALIVASILNMILGYSRAWGAFAKKFSPVIMTPVVCVVGLGLFQIGFPQVGKCVEIGLPMLILAIVVQQYAPLYFRHIHDRTTFLFERYSLLLCIGIVWAFAAILTAAGAYNHVSLKTQQHCRTDKSFLISSAPWIKISYPFHWGPPIFTAGHSFGMMGAVLVSSFESTGAHFATARLAGATPPPAHVLTRSIGLQGIGIFLAGLCGAPAGSSVSVENIGLLGLTKVGSRRVIQISTGFMIFFSIFGKFGAFFASIPLPIFAAIYCILFGIVAAVGISFSQFANKNSMRNIYIIGLSLFLGISIPQYFAEYTASAGRGPARTNAGWFNDIINTVFASGPTVALIVASLLDNTLEPRANENDRGLSWFTPFLRRRKGYSDPRNEEFYSYPIRVHDLVPHRFL

SEQ ID NO: 3964 - protein, 557 aa, Secale cereale
MGEMNHQPMQPQVGVPPPMGMQPMMNAPVGAGAMHQPYEQFNQLNYCVHSNPSWVQVAGLAFLHYLVMLGSTVMLVSTIVPAMGGGPGEKARVIQAFLFVSGINTLLQTLVGTRLPTVMNASFAFVVPVLSIARQYNTNDFESNHERFVHTMRATQGALIVASILNMILGYSRAWGAFAKKFSPVIMTPVVCVVGLGLFQIGFPQVGKCVEIGLPMLILAIVVQQYAPHYFRHFHERTTFLFERYSLLLCIGIVWAFAAILTAAGAYNHVSLKTQQHCRTDKSFLISSAPWIKISYPFHWGSPIFTAGHSFGMMGAVLVSSFESTGAHFATARLAGATPPPAHVLTRSIGLQGIGIFLAGLCGAPAGSSVSVENIGLLGLTKVGSRRVIQISTGFMIFFSIFGKFGAFFASIPLPIFAAIYCILFGIVAAVGISFSQFANKNSMRNIYIIGLSLFLGISIPQYFAEYTASAGRGPARTNAGWFNDIINTVFASGPTVALIVASLLDNTLDPRANEADRGLSWFTPFLRRRKGYSDPRNEEFYSYPIRVHDLVPHRFL

SEQ ID NO: 3965 - protein, 557 aa, Leymus cinereus x Leymus triticoides
  misc_feature (234)..(234): Xaa can be any naturally occurring amino acid
MGEMNHQPGPPPVGVPPPMGMQPMMNAPVGAGAMHQPYEQFNQLNYCVHSNPSWVQVAGLAFLHYLVMLGSTVMLVSTIVPAMGGGPGEKARVIQAFLFVSGINTLLQTLVGTRLPTVMNASFAFVVPVLSIARQFNPNDFESNHERFVHTMRATQGALIVASILNMILGYSRAWGAYAKKFSPVIMTPVVCVVGLGLFQIGFPQVGKCVEIGLPMLILAIVVQQYAPHYFRHXHERTTFLFERYSLLLCIGIVWAFAAILTAAGAYNHVSLKTQQHCRTDKSFLISSAPWIKISYPFHWGSPIFTAGHSFGMMGAVLVSSFESTGAHFATARLAGATPPPAHVLTRSIGLQGIGIFLAGLCGAPAGSSVSVENIGLLGLTKVGSRRVIQISTGFMIFFSIFGKFGAFFASIPLPIFAAIYCILFGIVAAVGISFSQFANKNSMRNIYIIGLSLFLGISIPQYFAEYTASAGRGPARTNAGWFNDIINTVFGSGPTVALMVASLLDNTLEPRANESDRGLSWFTPFLRRRKGYSDPRNEEFYSYPIRVHDLVPSRFL

SEQ ID NO: 3966 - protein, 556 aa, Brachypodium distachyon
MGEMNQPPPPPVGVPPPMGMQPMMNPPVGAGAMHPPHEQFHHLAYCVHSNPSWVQVAALAFLHYLVMLGSTVMLASIIVPAMGGSPGDKARVIQSFLFMGGINTLLQTLIGTRLPTVMNASFAFVVPVLSIAREVGQQDFPSNQQRFVHTIRTAQGALIVASVLNMILGYSTVWGAYAKKFSPVIMTPVVCVVGLGLFQLGFPQVGKCVEIGLPMLILAVVVQQYVPHYFRHFHERTTFLFERYSLLLCITIVWAFAAIITAAGAYNHVSLKTQQHCRTDKSYLMSSAPWIKIPLPFQWGTPIFTPGHSFGMMGAVLVSAFESTGAHFATARLAGATPPPAHVLSRSIGLQGIGMFLEGIFAAPCGSSVSVENIGLLGLTKVGSRRVIQISTGFMIFFSIFGKFGAFFASIPLPIFAAIYCILFGIVAAVGISYGQFVNKNSMRNIYIIGLSLFLGISIPQYFSEYTASAGSGPARTNAGWFNDIINTVFASGPTVALMVASLLDNTLEVRGHESDRGLSWFMPFLRRRKGYSDPRNEEFYKYPIRVHSLIPSRFH

SEQ ID NO: 3967 - protein, 557 aa, Setaria italica
MGETNQPPPPPVAAPPPMMPMQPMMAPAVGTGAIHPPHEQFHHLAYCVHSNPSWVQVAALAFLHYLVMLGSTVMLASTIVPAMGGNAGDKARVIQSFLFMSGINTLLQTLVGTRLPTIMNASFAFVVPVLSIAREMDPNDFTNNHLRFVHTMRTTQGALIVASILNMILGFSTVWGAYAKKFSPVIMTPVVCVVGLGLFELGFPQVGKCVEIGLPMLILAVIVQQYVPHYFSHIHERITFLFERYSLLLCIGIVWAFAAILTAAGAYNHVSLKTQLHCRTDKSFLMSSAPWIKIPYPFQWGTPIFTAGHSFGMMGAVLVAAFESTGAHFATARLAGATPPPGHVLSRSVGLQGIGMFLEGIFGAPAGSSVSVGNIGLLGLTKVGSRRVIQISTGFMIFFSIFGKFGAFFASIPLPIFAAIYCILFGIVAAVGVSFMQFANKNSMRNIYIIGLSLFLGISVPQYFNEYTSSAGRGPARTNAGWFNDILNTVFASGPTVALIVASVLDNTLEARGFDGDRGLPWFMPFLRRHKGYSDPRNEEFYSFPIRVHDLIPSRFL

SEQ ID NO: 3968 - protein, 556 aa, Oryza sativa
MGEMNQPPPPPVAVPPPMVMQPIMHPPVGTGAVFPPHEQFHHLAYCVHSNPSWVQVAALAFLHYLVMLGSTVMLASTIVPAMGGTPGDKARVIQSFLFMSGINTLLQTLVGTRLPTVMNASFAFVVPVLSIAKDFEQNNYASSHQRFTHTMRATQGALIVASILNMILGFSTIWGAFARKFSPVIMTPVVCVVGLGLFALGFPQVGKCVEIGLPMLILAVVVQQYVPYYFHHYHERITFLFERYSLLLCIGIVWAFAAILTAAGAYNHVSLKTQQHCRTDKSYLISSAPWIKIPYPFQWGTPIFTAGHSFGMMGAVLVSAFESTGAHFATARLAGATPPPASVLSRSVGLQGIGMFLEGIFGAPAGSSVSVENIGLLGLTKVGSRRVIQISTGFMIFFSIFGKFGAFFASIPLPIFAAIFCILFGIVAAVGVSYMQFVNKNSMRNIYIIGLSLFLGISVPQYFHEYTASASTGPARTNAGWFNDIINTVFASGPTVSLIVASILDNTLEFRGYENDRGLPWFMPFLHRRKGYSDPRNDEFYSFPIRVHDVIPSRFL

SEQ ID NO: 3969 - protein, 556 aa, Pennisetum glaucum
MGETDQPPPPVAAPPPMMPMQPMMAPPVGTGAIHPPHEQFHHLAYCVHSNPSWVQVAALAFLHYLVMLGSTVMLASTIVPAMGGTAGDKARVIQSFLFMSGINTLLQTLVGTRLPTIMNASFAFVVPVLSIAREMNPNDFTNNHQRFVHTMRTVQGALIVASILNMILGFSTVWGAYAKKFSPVIMTPVVCVVGLGLFEIGFPQVGKCVEIGLPMLILAVIVQQYVPHYFSHIHERITFLFERYSLLLCIGIVWAFAAVLTAAGAYNHVSLKTQLHCRTDRSFLMSSAPWIKIPYPFQWGTPIFTAGHSFGMMGAVLVAAFESTGAHFATARLAGATPPPGHVLSRSVGLQGIGMFLEGIIGAPAGSSVSVENIGLLGLTKVGSRRVIQISTGFMIFFSIFGKFGAFFASIPLPIFAAIYCILFGIVAAVGVSFMQFANKNSMRNIYIIGLSLFLGISVPQYFNEYTSSAGRGPARTNAGWFNDIINTVFASGPTVALIVASILDNTLEARGYEGDRGLPWFMPFLRRHKGYSDPRNEEFYSFPIRVHDFVPSRFL

SEQ ID NO: 3970 - protein, 556 aa, Panicum virgatum
MGETNQPPPPPVAAPPSMMPMPMMAPAVGAGAIHPPHEQFHHLAYCVHSNPSWVQVAALAFLHYLVMLGSTVMLASIIVPAMGGNAGDKARVIQSFLFMSGINTMLQTLIGTRLPTIMNASFAFVVPVLSIARDIDSNDFTNNHQRFLHTMRTTQGALIVASILNMILGFSTIWGAYAKKFSPVIMTPVVCVVGLGLFELGFPQVGKCVEIGLPMLILAVIVQQYVPRYFSHIHERITYLFERYSLLLCIGIVWAFAAILTAAGAYNHVSPKTQQHCRTDKSFLMSSAPWIKIPYPFQWGTPIFTAGHSFGMMGAVLVGAFESTGAHFATARLAGATPPPGHVLSRSVGLQGIGMFLEGIFGAPAGSSVSVENIGLLGLTKIGSRRVIQISTGFMIFFSIFGKFGAFFASIPLPIFAAIYCILFGIVAAVGVSFMQFANKNSMRNIYIIGLSLFLGISVPQYFNEYTSSAGRGPARTNAGWFNDIINTVFASGPTVALIVASVLDNTLEARGNDSDRGLSWFTPFLRRHKGYSDPRNDEFYSFPIRVHDFIPSRFL

SEQ ID NO: 3971 - protein, 558 aa, Sorghum bicolor
MGETNEQPPPPPPVAAPPPMMAMMVPPVGAGAIHPPHEQFHHLNYCVHSNPSWVQVAALAFLHYLVMLGSTVMLASVIVPAMGGNAGDKARVIQSLLFMSGINTLIQTLIGTRLPTVMNASFAFVVPVLSIAREIESNNDLLNDHERFKHTMRTAQGALIVASILNMILGFSTIWAAYAKKFSPVIMTPVVCVVGLGLFEIGFPQVGKCVEIGLPMLILAVLVQQYVPNYFGYIHPRVTFLFERYSLLLCIGIVWAFAAILTAAGAYDHVSLKTQQHCRTDKSRLISSAPWVKVPLPFQWGPPIFTAGHSFGMMGAVLVAAFESTGAHFATARLAGATPPPAHVLSRSVGLQGIGMFLGGIFSCPTGSSVSVENIGLLGLTKVGSRRVVQISTGFMIFFSLFGKFGAFFASIPLPIFAAIYCILFGIVAAVGVSFMQFANKNSMRNIYIIGLSLFLGISIPQYFNEYTSSADGRGPARTNAGWFNDIINTVFASGPTVALIVASVLDNTLEFRGYESDRGLSWFQPFLRRHKGYSDPRNEEFYSFPIRVHDFIPSRFL

SEQ ID NO: 3972 - protein, 556 aa, Zea mays
MGETNELPPPPVAAPPPMMPMQSMMVGAGAIHPPHEQFHHLNYCVHSNPSWVQVAALAFLHYLVMLGSTVMLATAIVPAMGGNAGDKARVIQSFLFMSGINTLLQTLIGTRLPTVMNASFAFVVPVLSIAKEIESNNFLNDHERFKHTMRTAQGALIVASILNMILGFSTIWGAYAKKFSPVIMTPVVCVVGLGLFQLGFPQVGKCVEIGLPMLILAVVVQQYVPNYFSYIHQRVTFLFERYSLLLCIGIVWAFAAILTAAGAYDHASPKTQQHCRTDKSFLMSSAPWIKIPLPFEWGPPIFTAGHSFGMMGAVLVAAFESTGAHFATARLAGATPPPAYVLSRSVGLQGIGMFLEGIFSVPAGSSVSVENIGLLGLTKVGSRRVIQISTGFMIFFSIFGKFGAFFASIPLPIFAAIYCILFGIVAAVGVSFMQFANKNSMRNIYIIGLSLFLGISVPQYFNGYTSSAGGHGPARTNAGWFNDIINTVFASGPTVALIVASVLDNTLEFRGYEADRGLSWFQPFLRRHKGYSDPRNEEFYSFPISVYDVIPDRFRR

SEQ ID NO: 3973 - protein, 107 aa, Secale cereale
MALGKLAVAALVASLLLLSTIKAADSPAPAAAPLGPPPHNIVDPSKDCGWACNLRCSANSRPNLCSRACLKCCSVCRCVPAGTAGNKETCGKCYTDWTTHGNKTKCP

SEQ ID NO: 3974 - protein, 107 aa, Triticum aestivum
MALGKLAVAALVASLLLLSTIKAADSPAPAAAPLGPPPHNIVDPSKDCGWACNLRCSANSRPKLCSRACLKCCSVCRCVPAGTAGNKETCGKCYTDWTMHGNNTKCP

SEQ ID NO: 3975 - protein, 107 aa, Lolium multiflorum
MALGKVAVAALVASLLLLSTIKAADYPPAAAPSLGPPPHKIVDPLKDCGDACDIRCSANSRKNMCSRACLKCCSVCRCVPAGTAGNKETCGKCYTDWTTHGNKTKCP

SEQ ID NO: 3976 - protein, 107 aa, Brachypodium distachyon
MAVGKLAVVALVASSLLMLSTIKAAGYAPAPAPLGPPPHKIVDPSKDCGGACDVRCSENKRKNMCSRACLKCCSVCHCVPAGTAGNQETCGKCYTDWTTHGNRTKCP

SEQ ID NO: 3977 - protein, 340 aa, Triticum aestivum
MANQLLSTVAHRDTLPEGYTRPENDRPQLADVVTDSNIPLIDLASPDKHLVIAEIDQACRTYGFFQIVNHGISEELLEKVMAVGLEFFRLPPEEKAKLYSDEPSKKIRLSTSFNVRKETVHNWRDYLRLHCHPLEEFVPDWPSNPETFKEIISTYCREVRLLGLRLLGAISLGLGLEEDYIENVLGEQEQHMAVNDYPRCPEPDLTYGLPKHTDPNALTILLMDPHVSGLQVLKNGAQWIAVDPRPNALVVNLGDQLQALSNGAYKSVWHRAVVNAARERLSVASFLCPCNSAVIGPAAKLVGDGDEPVYRSYTYDEYYKKFWSRNLDQDHCLELFTGQK

SEQ ID NO: 3978 - protein, 340 aa, Triticum aestivum
MANQLLSTVAHRDTLPEGYTRPENDRPQLADVVTDSNIPLIDLASPDKHRVIAEIDQACRTYGFFQIINHGISEELLEKVMAVGLEFFRLPPEEKAKLYSDEPSKKIRLSTSFNVRKETVHNWRDYLRLHCHPLEEFVPDWPSNPETFKEIISTYCREVRLLGLRLLGAISLGLGLEEDYIENVLGEQEQHMAVNYYPRCPKPDLTYGLPKHTDPNALTILLMDPHVSGLQVLKDGAQWIAVDPRPNALVVNLGDQLQALSNGAYKSVWHRAVVNAARERLSVASFLCPCNSAVIGPVAKLVGDGDEPVYRSYTYDEYYKKFWSRNLDQDHCLELFTGQK

SEQ ID NO: 3979 - protein, 340 aa, Triticum aestivum
MANQLLSTVAHRDTLPEGYTRPENDRPQLADVVTDSNIPLIDLASPDKHRVIAEIDQACRTYGFFQIINHGISEELLEKVMAVGLEFFRLPPEEKAKLYSDEPSKKIRLSTSFNVRKETVHNWRDYLRLHCHPLEVFVPDWPSNPETFKEIISTYCREVRLLGLRLLGAISLGLGLEEDYIENVLGEQEQHMAVNYYPRCPEPDLTYGLPKHTDPNALTILLMDPHVSGLQVLKDGAQWIAVDPRPNALVVNLGDQLQAVSNGAYKSVWHRAVVNAARERLSVASFLCPCNSAVIGPADKLVGDGDEPVYRSYTYDEYYKKFWSRNLDQDHCLELFTGQK

SEQ ID NO: 3980 - protein, 340 aa, Triticum aestivum
MATQLLSTVAHRDTLPEGYTRPENDRPQLADVVTDSNIPLIDLASPDKHRVIAEIDQACRTYGFFQIINHGISEELLEKVMAVGLEFFRLPPEEKAKLYSDEPSKKIRLSTSFNVRKETVHNWRDYLRLHCHPLEEFVPDWPSNPETFKEIISTYCCEVRLLGLRLLGAISLGLGLEEDYIENVLGEQEQHMAVNYYPRCPKPDLTYGLPKHTDPNALTILLMDPHVSGLQVLKDGAQWIAVDPRPNALVVNLGDQLQALSNGAYKSVWHRAVVNAARERLSVASFLCPCNSAVIGPVAKLVGDGDEPVYRSYTYDEYYKKFWSRNLDQDHCLELFTGQK

SEQ ID NO: 3981 - protein, 340 aa, Secale cereale
MANQLLSTVAHHDTLPKGYTRPENDRPQLADVVTDNNIPLIDLGSPDKHRVIAEIDQACRTYGFFQIINHGISEELMEKVMAVGLEFFRLPPEEKAKLYSDEPSKKIRLSTSFNVRKETVHNWRDYLRLHCHPLEEFVPDWPSNPETFKEIISTYCREVRLLGLRLLGAISLGLGLEEDYIENVLGEQEQHMAVNYYPRCPEPDLTYGLPKHTDPNALTLLLMDPHVSGLQVLKDGAQWIAVDPRPNALVVNLGDQLQALSNGAYKSVWHRAVVNAARERLSVASFLCPCNSAVIGPAAKLVGDGDEPVYRSYTYDEYYKKFWSRNLDQDHCLELFTGQK

SEQ ID NO: 3982 - protein, 340 aa, Avena sativa
MANQLLSTVAYRDSLPEGYTRPEHDRPRLADVATDTNIPLIDLASPDMHRVIAQIDQACRTYGFFQVINHGISEELLAKVMAVGLEFFRLPPEEKAKLYSDEPSKKIRLSTSFNVRKETVHNWRDYLRLHCHPLEEFVPDWPSNPETFKETISAYCREVRQLGLRLLGAISLGLGLEADYVEKVLGEQEQHMAVNYYPRCPEPDLTFGLPKHTDPNALTILLMDPRVSGLQVLKDGAHWIAVDPRPNALVINLGDQLQALSNGAYKSVWHRAVVNAAQERLSVASFLCPCNSAVIGPAAKLVGDGEEPVYRSYTYDEYYKRFWSRNLDQEHCLELFRGQQ

SEQ ID NO: 3983 - protein, 339 aa, Brachypodium distachyon
MANQLLSTVSCHDTLPEGYARPESDRPRLAEVATDSNIPLIDLASPDKLRVIAEIDRACRTYGFFQVINHGISEELLEKVMAVGLEFFRLPPEEKAKLYSDEPSKKIRLSTSFNVRKETVHNWRDYLRLHCHPLEEFVPDWPSNPEAFKEIISTYCREVRLLGLRLMGAISLSLGLDENYVENVLGEQEQHMAVNYYPRCPEPDLTYGLPKHTDPNALTVLLQDPNVSGLQVLKDGQWIAVDPRPNALVINLGDQLQALSNGAYKSVWHRAVVNAAQERMSVASFLCPCNSAVIGPAAKLVGDGDEPVYRSYTYDEYYNKFWSRNLDQEHCLELFRGQK

SEQ ID NO: 3984 - protein, 340 aa, Oryza sativa
MATTQLLSTVEHRETLPEGYARPESDRPRLAEVATDSNIPLIDLASPDKPRVIAEIAQACRTYGFFQVTNHGIAEELLEKVMAVALEFFRLPPEEKEKLYSDEPSKKIRLSTSFNVRKETVHNWRDYLRLHCHPLEEFVPEWPSNPAQFKEIMSTYCREVRQLGLRLLGAISVSLGLEEDYIEKVLGEQEQHMAVNYYPRCPEPDLTYGLPKHTDPNALTILLPDPHVAGLQVLRDGDQWIVVNPRPNALVVNLGDQIQALSNDAYKSVWHRAVVNAVQERMSVASFMCPCNSAVISPARKLVADGDAPVYRSFTYDEYYKKFWSRNLDQEHCLELFKGQ

SEQ ID NO: 3985 - protein, 340 aa, Oryza sativa
MATTQLLSTVEHRETLPEGYARPESDRPRLAEVATDSNIPLIDLASPDKPRVIAEIAQACRTYGFFQVTNHGIAEELLEKVMAVALEFFRLPPEEKEKLYSDEPSKKIRLSTSFNVRKETVHNWRDYLRLHCHPLEEFVPEWPSNPAQFKEIMSTYCREVRQLGLRLLGAISVSLGLEEDYIEKVLGEQEQHMAVNYYPRCPEPDLTYGLPKHTDPNALTILLPDPHVAGLQVLRDGDQWIVVNPRPNALVVNLGDQIQALSNDAYKSVWHRAVVNPVQERMSVASFMCPCNSAVISPARKLVADGDAPVYRSFTYDEYYKKFWSRNLDQEHCLELFKGQ

SEQ ID NO: 3986 - protein, 343 aa, Sorghum bicolor
MGSQLLSTVERREVLPECYIRPEFDRPRLAEVTTDSDVPLIDLASPDKQRVIGQIGLACRTYGFFQVINHGIEEELLEKMMAVGLEFFRLPPEEKEKLYSDEPFKKIRLSTSFNVRKETVRNWRDYLRLHCHPLEEFLPEWPSNPESFKEVVSAYCREVRLLGLRLLGMISLSLGLEEDYIEKALGEQEQHMAVNYYPQCPEPDLTYGLPKHTDPNALTVLLQDPNVAGLQVLKGGDQWIAVSPRRNAFVINLGDQLQALSNGAYKSVWHRAVVNAAQERMSVASFLCPCNSAVISPAAALVGEGDAPVYRSYTYEEYYKKFWSRSLDQEHCLELFRSTQQLQ

SEQ ID NO: 3987 - protein, 355 aa, Unknown
  Sequence found in Organisms: Pseudoroegneria spicata, Triticum aestivum
MRGKKPLKELTLSVPAQETPVDKFLTASGTFKDGELRLNQRGLQLISEENGDEHQSTKMKVEDVQLSMDDLEMIQVIGKGSGGVVQLVRHKWVGTFYALKGIQMNIQESVRKQIVQELKINQATQSPHIVLCHQSFYHNGVIYLVLEYMDRGSLADIIKQVKTILEPYLAVLCKQVLEGLLYLHHERHVIHRDIKPSNLLVNHKGEVKITDFGVSAVLASSIGQRDTFVGTYNYMAPERISGSSYDYKSDVWSLGLVILECAIGRFPYTPPEGEGWLSFYELLEAIVDQPPPSAPADQFSPEFCSFISSCIQKDPAERMSASELLNHAFIKKFEDKDLDLRILVESLEQPMNVPE

SEQ ID NO: 3988 - protein, 256 aa, Leymus cinereus x Leymus triticoides
MRGKKPLKELTLSVPAQETPVDKFLTASGTFKDGELRLNQRGLQLISEENGDEHQSTKMKVEDVQLSMDDLEMIQVIGKGSGGVVQLVRHKWVGTFYALKGIQMNIQESVRKQIVQELKINQATQSPHIVLCHQSFYHNGVIYLVLEYMDRGSLADIIKQVKTILEPYLAVLCKQVLEGLLYLHHERHVIHRDIKPSNLLVNHKGEVKITDFGVSAVLASSIGQRDTFVGTYNYMAPERISGSSYDYKSDVWSLAW

SEQ ID NO: 3989 - protein, 356 aa, Brachypodium distachyon
MRGKKPLKELKLSVPAQETSVDKFLTASGTFKDGELRLNQRGLRLISEEENGDEHQSTNMKVEDVQLSMDDLEMIQVIGKGSGGVVQLVQHKWVGTFYALKGIQMNIQEAVRKQIVQELKINQATQSPHIVSCHQSFYHNGVIYLVLEYMDRGSLADIIKQVKTILEPYLAVLCKQVLEGLLYLHHERHVIHRDIKPSNLLVNHKGEVKITDFGVSAVLASSIGQRDTFVGTYNYMAPERISGSSYDYKSDVWSLGLVILECAIGRFPYTPSEGEGWLSFYELLEAIVDQPPPGAPADQFSPEFCSFISACIQKDPAERMSASELLNHAFIKKFEGKDLDLRILVESLEPPMNVPE

SEQ ID NO: 3990 - protein, 355 aa, Avena sativa
MRGKKTLKDLKLDVPAQETPVDKFLTASGTFKDGELRLNQRGLQLISEENGDEHQSTNMKVEDVQLSMDDLEMIQVIGKGSGGVVQLVQHKWVGTFYALKGIQMNIQEAVRKQIVQELKINQATQSPHIVSCHQSFYHNGVIYLVLEYMDRGSLADIIKQVKTILEPYLAVLCKQVLEGLLYLHHDRHVIHRDIKPSNLLVNHKGEVKITDFGVSAVLASSIGQRDTFVGTYNYMAPERISGSSYDYKSDVWSLGLVILECAIGRFPYIPPEGEGWLSFYELLEAIVDQPPPSAPADQFSPEFCSFISSCIQKDPAERMSASELLNHPFIKKFEGKDLDLKILVETLEPPMNVPE

SEQ ID NO: 3991 - protein, 355 aa, Oryza sativa
MRGKKPHKELKLSVPAQETPVDKFLTASGTFKDGELRLNQRGLQLISEETADEPQSTNLKVEDVQLSMDDLEMIQVIGKGSGGIVQLVRHKWVGTLYALKGIQMNIQEAVRKQIVQELKINQATQNAHIVLCHQSFYHNGVIYLVLEYMDRGSLADIIKQVKTILEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGEGWLSFYELLEAIVDQPPPSAPADQFSPEFCAFISSCIQKDPAERMSASELLNHPFIKKFEDKDLDLRILVESLEPPMNISE

SEQ ID NO: 3992 - protein, 355 aa, Setaria italica
MKGKKPLKELKLSVPAQEIPVDKFLTASGTFKDGELRLNQSGLRLTSEENGDEDESTKLKVEDVQLSMDDLEMIQVIGKGSGGVVQLVRHKWVGTLYALKGIQMNIQESVRKQIVQELKINQATQSPHIVLCHQSFYHNGVIYLVLEYMDRGSLADIIKQVKTVLEPYLAVLCKQVLEGLLYLHHERHVIHRDIKPSNLLVNRKGEVKITDFGVSAVLASSVGQRDTFVGTYNYMAPERISGSSYDYKSDIWSLGLVILECAIGRFPYIPSEGEGWSSFYELLEAIVDQPPPSAPADQFSPEFCSFISSCIQKDPAQRMSAAELLNHPFLKKFEDKDLDLRILVESLEPPMNIPE

SEQ ID NO: 3993 - protein, 355 aa, Pennisetum glaucum
MKGKKPLKELKLSVPAQETPVDKFLTASGTFKDGELRLNQSGLRLISEENGDEDESTKLKVEDVQLSMDDLEMIQVIGKGSGGVVQLVRHKWVGTLYALKAIQMNIQESIRKQIVQELKINQATQSPHIVMCHQSFYHNGVIYLVLEYMDRGSLADIIKQVKTVLEPYLAVLCRQVLEGLLYLHHERHVIHRDIKPSNLLVNRKGEVKITDFGVSAVLANSIGQRDTFVGTYNYMAPERISGSSYDYKSDIWSLGLVILECAIGRFPYIPSEGEGWLSFYELLEAIVDQPPPSAPADQFSPEFCSFISSCIQKDPAQRMSASELLNHPFLKKFEDKDLDLRILVESLEPPMNIPE

SEQ ID NO: 3994 - protein, 355 aa, Panicum virgatum
MRGKKPLKDLKLSVPVQESPVDKFLTASGTFKDGELRLNQSGLRLISEENGDEDESTKLKVEDVQLSMDDLEMIQVIGKGSGGVVQLVRHKWVGTLYALKGIQMNIQESVRKQIVQELKINQATQSPHIVLCHQSFYHNGVIYLVLEYMDRGSLADIIKQVKTVLEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGEGWLSFYELLEAIVDQPPPSAPADQFSPEFCSFISSCIQKDPAQRMSASELLNHPFLKKFEDKDLDLRGLVETLEPPMNIPE

SEQ ID NO: 3995 - protein, 355 aa, Sorghum bicolor
MRGKKPLKDLRLSVPAQETPVDKFLTASGTFKDGELRLNQSGLRLISEENGGEDESTKLKVEDVQLSMDDLEMIQVIGKGSGGIVQLVRHKWVGTLYALKGIQMNIQESVRKQIVQELKINQATQCPHIVMCHQSFYHNGVIYLVLEYMDRGSLADIVKQVKTVLEPYLAVLCKQVLEGLLYLHHERHVIHRDIKPSNLLVNRKGEVKITDFGVSAVLASSIGQRDTFVGTYNYMAPERISGSSYDYKSDIWSLGLVILECAIGRFPYIPSEGEGWLSFYELLEAIVDQPPPSAPADQFSPEFCSFISSCIQKDPAQRMSASELLNHPFLKKFEDKDLDLRILVEDLEPPMNIPE

SEQ ID NO: 3996 - protein, 350 aa, Saccharum officinarum
MRGKKPMKELKLSVPAQETPVDKFLTASGTFKDGELRLNQSGLRLISEENGDEDESTKLKVEDVQLSMDDLEMIQVIGKGSGGVVQLVRHKWVGTLYALKGIQMNIQESVRKQIVQELKINQATQSPHIVMCHQSFYHNGVIYLVLEYMDRGSLADIVKQVKTVLEPYLAVLCKQVLEGLLYLHHERHVIHRDIKPSNLLVNRKGEVKITDFGVSAVLASSIGQRDTFVGTYNYMAPERISGSSYDYKSDIWSLGLVILECAIGRFPYIPSEGEGWLSFYELLEAIVDQPPPSAPADQFSPEFCSFISSCIQKDPAQRMSASELLNHPFLKKFEDKDLDLRILVENLEPQ

SEQ ID NO: 3997 - protein, 172 aa, Avena sativa
MRGKKTLKDLKLDVPAQETPVDKFLTASGTFKDGELRLNQRGLQLISEENGDEHQSTNMKVEDVQLSMDDLEMIQVIGKGSGGVVQLVQHKWVGTFYALKGIQMNIQEAVRKQIVQELKINQATQSPHIVSCHQSFYHNGVIYLVLEYMDRGSLADIIKQVKTILEPYLAVL

SEQ ID NO: 3998 - protein, 348 aa, Setaria italica
MELKLAVPAQETPVDKFLTASGTFKDGELRLNQRGLRLISEENGDENQSTNLKVEDVQLSMDDLEMIQVIGKGSGGVVQLVRHKWVGTLYALKGIQMNIQESVRKQIVQELKINQATQSPHIVMCHQSFYHNGVIYLVLEYMDRGSLADIIKQVKTVLEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGEGWISFYELLEAIVDQPPPSAPADQFSPEFCSFISSCIQKDPAERMSASELLNHPFIKKFEGKDLDLRTLVESLEPPMNIPE

SEQ ID NO: 3999 - protein, 358 aa, Elaeis guineensis
MKGPKPLKQLKVAVPAQETPVDKFLTASGTFTDGGLRLNQRGLRLISEQTENRVRQPDVKEEDMQFSLEDLETIKVIGKGSGGVVQLVRHKWLGTLYALKGIQMNIQETVRKQIVQELKINQASQCPHVVVCYHSFYHNGVISLVLEYMDRGSLADVIKQVKTILEPYLSVVCKQVLKGLVYLHHERHVIHRDIKPSNLLVNNKGEVKITDFGVSAVLANSMGQRDTFVGTYNYMSPERISGSSYDYKSDIWSLGLVILECAIGCFPYIPSEQEEGWPSFYELLEAIVDQPPPSAPSDQFSPEFCSFISACIQKDPHERMSSLELLNHPFIKKFEEKDIDLAILVGSLDPPVDVPGDV

SEQ ID NO: 4000 - protein, 527 aa, Triticum aestivum
MALAGAANATFRPRLVTAAADTSDTNTRRRHWKAGEFPFPTTSPSSGTQQRRRPRTTERPPPPPPSKGEDPEGRGRQRHWKAGEDPEGGGRQRHWRAGEFPAAAESQSQSGRRGRARTPIKNVQKRLDARADAKAWACTVTEALADRIAAKNWREALQVFEMLKEQTFYYPKEGTYMKLLLLLGRSGQPSLAQHLFTEMQQQGCQPTPELYTALIGAYCRNGLLDEALKLLEDMKAAPLCQPDVYTYSILIKAFVDASRFDLVDAMYKEMAERSVTPNTVTQNIVLSGYCRAGRLDDMEKLLSAMLESANCKPDVWTMNIILSLFGNSGQVELMEKWYEKFRGYGIEPETRTFNILIGAYGKKRMYDKMSAVMEYMRRLAFPWTTATYNNVIEAFAEAGDAKNMEDTFNQMRSEGMKPDTKTFCCLINGFSNAALFHKVVGMVKLAERLDVPANTSFHNSVLAACAKAEDLMEMERVFRHMKHMQCEPDAITYSILLEAYRKEGMFDKMYALQQENPSLVSTELVMV

SEQ ID NO: 4001 - protein, 512 aa, Brachypodium distachyon
MALAAANATFRPRLVSASAAADTSDTHTRRRHWKAGEFPFPTTSPSSSGRRPRPTTTKERPPPPSKGKKEDPIPSPQGRGQRHWKAGEFPESQSGGSRSRSRTPIKNIRKRQDARSDAKAWAPTVTEALSDRIAAKNWPEALQVFEMLKEQPFYYPKEGTYMKLLLLLGRSGQPALAHRLFADMQQQGCQPTPELYTALIAAYCRSGLLDDALRLLGDMKAAPLCQPDVYTYSTLIKALVDASRFDLVDAMYKEMAERGVAPNTVTQNIVLSGYGRAGRMDDMEKLLSAMLDSTASKPDVWTMNIILSLFGNSGQVDLMEKWYEKFRGYGIEPETRTLNILIGAYGKKRMYDKMSAVMEFMRKLAFPWTTSTYNNVIEAFAEAGDEKNMEQTFNQMRSEGMKPDTKTFCCLINGFSKAGLFHKVVGMVKLAERLDVPANTSFHNSVLAACARAGDLVEMERVFRHMKHVQCAPDATTYSILVEAYRKEGMTDKVYDLQQENPSLVSTELVMV

SEQ ID NO: 4002 - protein, 444 aa, Triticum aestivum
EDPEGRGRQRHWRAGEFPAAAESQSQSGRRGRARTPIKNVQKRLDARADAKAWACTVTEALADRIAAKNWREALQVFEMLKEQTFYYPKEGTYMKLLLLLGRSGQPSLAQHLFTEMQQQGCQPTPELYTALIGAYCRNGLLDEALKLLEDMKAAPLCQPDVYTYSILLKAFVDASRFDLVDAMYKEMAERSVTPNTVTQNIVLSGYCRAGRLDDMEKLLSAMLESANCKPDVWTMNIILSLFGNSGQVELMEKWYEKFRGYGIEPETRTFNILIGAYGKKRMYDKMSAVMEYMRRLAFPWTTATYNNVIEAFAVAGDAKNMEDTFNQMRSEGMKPDTKTFCCLINGFSNAALFHKVVGMVKLAERLDVPANTSFHNSVLAACAKAEDLMEMERVFRHMKHMQCEPDAITYSILLEAYRKEGMTDKMYALQQENPSLVSTELVMV

SEQ ID NO: 4003 - protein, 434 aa, Triticum aestivum
HWRAGEFPAAAESQSQSGRRGRARTPIKNVQKRLDARADAKAWACTVTEALADRIAAKNWREALQVFEMLKEQTFYYPKEGTYMKLLLLLGRSGQPSLAQDLFTEMQQQGCQPTPELYTALIGAYCRNGLLDEALKLLEDMKAAPLCQPDVYTYSILLKAFVDASRFDLVDAMYKEMAERSVTPNTVTQNIVLSGYCRAGRLDDMEKLLSAMLESANGKPDVWTMNIILSLFGNSGQVELMEKWYEKFRGYGIEPETRTFNILIGAYGKKRMYDKMSAVMEYMRRLAFPWTTATYNNVIEAFAEAGDAKNMEDTFNQMRSEGMKPDTKTFCCLINGFSNAALFHKVVGMVKLAERLDVPANTSFHNSVLAACAKAEDLMEMERVFRHMKHMQCEPDAITYSILLEAYRKEGMTDKMYALQQENPSLVSTELVMV

SEQ ID NO: 4004 - protein, 98 aa, Secale cereale
MAAAASSSAWKARWLRPEAYPIFAATGVAVGICVMQLVRNITTNPEVRVTKENRAAGVLDNHDEGRRYARHPFRRFIDGKSAEIMPGINSFFTAPPKN

SEQ ID NO: 4005 - protein, 98 aa, Triticum aestivum
MAAAASSSAWKARWLRPEAYPIFAATGVAVGICVMQLVRNITTNPEVRVTKENRAAGVLDNHDEGRRYARHPFRRFIDGKSAEIMPGINSFFTDPPKN

SEQ ID NO: 4006 - protein, 97 aa, Festuca arundinacea
MAAAASSAWKTRWLRPEAYPIFAATGVAVGICVMQLVRNITTNPEVRVTKENRAAGILDNHDEGRRYSRHPFRRFIDGKSSEIMPAINNFFTDPSKS

SEQ ID NO: 4007 - protein, 96 aa, Avena sativa
MAGAASNAWKTRWLRPEAYPIFAATGVAVSICVMQLVRNITTNPEVRVTKENRAAGILDNHDEGRRYSRHPFRRFIDGKSSEIMPGINSFFTDPPK

SEQ ID NO: 4008 - protein, 126 aa, Avena sativa
MAGAASNAWKTRWLRPEAYPIFAATGVAVSICVMQLVRNITTNPEVRVTKENRAAGILDNHDEGRRYSRHPFRRFIDGKSSEIMPGINSFSPTHPSRRDGTAGRRDLLLQERKEFWNFLSQQFSSY

SEQ ID NO: 4009 - protein, 113 aa, Triticum aestivum
MGCAGSTPKSDDSSKKLKKPKPWKHTQSITPAQLKQMREEFWDTTPHYGGQKEIWDALRAAAEADLSLAQTIVDSAGIIVSNSDMTLCYDERGAKYELPKYVLSEPTNLIREK

SEQ ID NO: 4010 - protein, 113 aa, Secale cereale
MGCAGSTPKSDDSSKKLKKTKPWKHTQSITPAQLKQMREEFWDTTPHYGGQKEIWDALRAAAEADLSLAQTIVDSAGIIVSNSDMTLCYDERGAKYELPKYVLSEPTNLSREE

SEQ ID NO: 4011 - protein, 113 aa, Secale cereale
MGCAGSTPKSDDTSKKLKKPKPWKHTQSITPAQLKQMREEFWDTTPHYGGQKEIWDALRAAAEADLSLAQTIVDSAGIIVSNSDMTLCYDERGAKYELPKYVLSEPTNLSREE

SEQ ID NO: 4012 - protein, 113 aa, Triticum aestivum
MGCAGSTPKSDDSSKKLKKPKPWKHTQSITPAQLKQMREEFWDTTPHYGGQKEIWDALRAAAEADLALAQTIVDSAGIIVSNSDMTLCYDERGAKYELPKYVLSEPTNLIREK

SEQ ID NO: 4013 - protein, 113 aa, Avena sativa
MGCAGSTPTSDDTSKKLKKPKPWKHTQAITPAQLKQMREEFWDTTPHYGGQKEIWDALRAAAEAELSLAQTIVDSAGIIVSNADMTLCYDERGAKYELPKYVLSEPSNLIKEA

SEQ ID NO: 4014 - protein, 113 aa, Festuca arundinacea
  misc_feature (33)..(33): Xaa can be any naturally occurring amino acid
MGCAGSTPTSDDNSKKLKKPKPWKHTQAITPAXLKQMREEFWDTTPHYGGQKEIWDALRAAAEAELYLAQTIVDSAGIIVSNSDMTLCYDERGAKYELPKYVLSEPSNLIKEE

SEQ ID NO: 4015 - protein, 113 aa, Avena sativa
MGCAGSTPTSDDISKKLKKPKAWKHTQAITPAQLKQMREEFWDTTPHYGGQKEIWDALRAAAEAELSLAQTIVDSAGIIVSNADMTLCYDERGAKYELPKYVLSEPSNLIKEA

SEQ ID NO: 4016 - protein, 113 aa, Oryza sativa
MGCAGSTPKTDDNSKKLKKPKPWKHNQAITTTQLKQMRDEFWDTAPHYGGQKEIWDALRAAAEAELSLAQTIVDSAGIIVSNSDMTICYDERGAKYELPKYVLSEPTNLIREG

SEQ ID NO: 4017 - protein, 114 aa, Festuca arundinacea
MGCAGSTPKVDESSKKLRKPKPWKHTQPITPAELKQMCDEFWDTAPHYGGQKEIWDALRAAATEADLTLAQTIVDSAGIIVSNPDLTVCYDERGAKYELPNYVLSEPTNLIRDG

SEQ ID NO: 4018 - protein, 113 aa, Setaria italica
MGCAGSTPKVDENSKKLKKPKAWKHTQPITPAQLKQMRDEFWDTAPHYGGQKEIWDALKVAAESDLALAQTIVDSAGIIVSNPDMTLCYDERGAKYELPKYVLSEPTNLIRQG

SEQ ID NO: 4019 - protein, 113 aa, Pennisetum glaucum
MGCAGSTPKVDENSKKLKKPKAWKHTQPITLAQLKQMRDEFWDTAPHYGGQKEIWDALKVAAESDLALAQTIVDSAGIIVSNPDMTLCYDERGAKYELPKYVLSEPTNLIREG

SEQ ID NO: 4020 - protein, 113 aa, Oryza sativa
MGCAGSTPKVDENSKKLKKPKPWKHTQAITPTQLSKMREEFWDTAPHYGGQKEIWDALRAAAEAELPLAQTIVNSAGIVVSNSDMTLCYDERGAKYELPKYVLSEPTNLIREP

SEQ ID NO: 4021 - protein, 113 aa, Sorghum bicolor
MGCAGSTPKVDENSKKLKKPKAWKHTQPITPAQLKQMRDEFWDTAPHYGGQKEIWDALRVAAESDLALAQTIVDSAGIIISNPDMTLCYDERGAKYELPKYVLSEPTNLIRDG

SEQ ID NO: 4022 - protein, 114 aa, Avena sativa
MGCAGSTPKVDESSKKLRKPKPWKHTQPITPAQVKQMRDEFWDTAPHYGGQKEIWDALRAAATEADLTLAQTIVDSAGIIVSNPDLTVCYDERGAKYELPNYVLSEPTNLIRDG

SEQ ID NO: 4023 - protein, 113 aa, Setaria italica
MGCAGSTPKTDDNGKKLKKPKPWKHTQAITLAQLRQMRDEFWDTAPHYGGQKEIWDALRAAADSDLALAQTIVDSAGIIVSNSDMTLCYDERGAKYELPKYVLSEPTNLIREG

SEQ ID NO: 4024 - protein, 113 aa, Zea mays
MGCAGSTPKVDENSKKLKRPKAWKHTQPITPARLKQMRDEFWDTAPHYGGQKEIWDALRVAAESDLALAQTIVDSAGIIVSNPDMTLCYDERGAKYELPKYVLSEPANLIRDG

SEQ ID NO: 4025 - protein, 113 aa, Pennisetum glaucum
MGCAGSTPKTDDNGKKLKKPKPWKHTQAITPAQLRQMRDEFWDTAPHYGGQKEIWDALRAAADSDLALAQTIVDSAGIIVSNSDMTLCYDERGAKYELPKYVLIEPTNLIREG

SEQ ID NO: 4026 - protein, 113 aa, Saccharum officinarum
MGCAGSTPKTDDNGKKLKKPKPWKHTQAITPAQLRQMRDEFWDTAPHYGGQKEIWDALRAAADSDLALAQTIVDSAGIIVSNSDMTLCYDERGAKYELPKYVLSEPTNLIRDG

SEQ ID NO: 4027 - protein, 113 aa, Panicum virgatum
MGCAGSTPKVDENSKKLKKPKAWKHTQPITSAQLKQMRDEFWDTAPHYGGQKEIWDALKVAAESDLALAQTIVDSAGIIVSNPDMTLCYDERGAKYELPKYVLSEPTNLIRDG

SEQ ID NO: 4028 - protein, 113 aa, Panicum virgatum
MGCAGSTPKTDDNGKKLKKPKPWKHTQAITPAQLKQMRDEFWDTAPHYGGQKEIWDALRAAADSDLELAQTIVDSAGIIVSSSDMTLCYDERGAKYELPKYVLSEPTNLIRDG

SEQ ID NO: 4029 - protein, 113 aa, Triticum aestivum
MGCAGSTPKVDESSKNLRKPKPWKHTQPITPAQLKQMRDEFWDTAPHYGGQKEIWDALRAATDADLTLAQTIVDSAGIIVSNPDLTLCYDERGAKYELPNYVLSEPTNLIRDG

SEQ ID NO: 4030 - protein, 113 aa, Triticum aestivum
MGCAGSTLKVDESSKNLRKPKPWKHTQPITPAQLKQMRDEFWDTAPHYGGQKEIWDALRAATDADLTLAQTIVDSAGIIVSNPDLTLCYDERGAKYELPNYVLSEPTNLIRDG

SEQ ID NO: 4031 - protein, 113 aa, Hordeum vulgare
MGCAGSTPKVDESSKNLRKPKPWKHTQPITPAQLKQMRDEFWDTAPHYGGQKEIWDALQAATEADLTLAQTIVDSAGIIVSNPDLTLCYDERGAKYELPNYVLSEPTNLVRDG

SEQ ID NO: 4032 - protein, 113 aa, Panicum virgatum
MGCAGSTPKTDDNGKKLKKPKPWKHTQAITPAQLRQMRDEFWDTAPHYGGQKEIWDALRAAADSDLALAQTIVDSAGIIVSSSDMTLCYDERGAKYELPKYVLSEPTNLIRDG

SEQ ID NO: 4033 - protein, 113 aa, Secale cereale
MGCAGSTPKVGESSKNLRKPKPWKHSQPITPAQLKQMRDEFWDTAPHYGGQKEIWDALRAAADADLTLARTIVDSAGIIVSNPDLTLCYDERGAKYELPNYVLSEPTNLVREG

SEQ ID NO: 4034 - protein, 114 aa, Musa acuminata
MGCAGSTPAKGDENTKKLQKPKPWKHTQQITRAQLKQMRDEFWDTAPHYGGQKEIWDALRAAAEADLDLAQAIVDSAGIIIPNADMTLCYDERGAKYELPKYVLSEPTNLIRDS

SEQ ID NO: 4035 - protein, 113 aa, Panicum virgatum
MGCAGSTPKVNENNKKLKKPKAWKHSQPITPAQLKQMRDEFWDTAPHYGGQKEILDALKVAAESDLALAQTIVDSAGIIVSNPDMTLCYDERGAKYELPKYVLSEPTNLIRDG

SEQ ID NO: 4036 - protein, 113 aa, Brachypodium distachyon
MGCAGSKPRVDESGKKLRKPKPWKHTQPLTPAQLKQMRDEFWDTAPHYGGQKEIWDALRAATEADLPLAQTIVDSAGVIVSNSDLTLCYDERGAKYELPKYVLSEPTNLIPVG

SEQ ID NO: 4037 - protein, 113 aa, Unknown
  Sequence found in Organisms: Sorghum bicolor, Triticum aestivum
MGCAGSTLKPEDNGKKLKKPKPWKHTQAITPAQLRQMRDEFWDTAPHYGGQKEIWDALRAAADSDLALAQTIVDSAGIIISNSDMTLCYDERGAKYELPKYVLSEPTNLIKDG

SEQ ID NO: 4038 - protein, 359 aa, Secale cereale
MGARSTATAGEAVARRGGRKKGAMAPSVGGVEAAMAGGRRSRAPPRLVGYEELPEYLKDNEYIRGHYRVEWPIRDALLSAFSWHNETLNVWTHLGGFLLFLALAVAGGGPEAAHEVAPGIMRFVVGSANSSWKSDQTGLPSHDAAVTVLGGHGVPRWPRMVFLVGAMACLAISATAHLLACHSRRATVVFWQLDYAGISIMIVASFVPPVYYAFLCHPPARVAYLSAITVLGALVVAVLLSPSCSSPRYRRLRATLFLAMGMSGVIPAVHALWINWGHTACYLALGLEVAMGLAYAVGAWFYVSRVPEKWRPGVFDVVGHSHQIFHVFVLVGAITHYVAVAVLLDWREKAAVSCGGTAS

SEQ ID NO: 4039 - protein, 428 aa, Triticum aestivum
DRELSAAAAVSRRSKRVGTAATAIRRYRCDPTYRFLHDRTADLFASLLVEDMRKLANDDVRELSLAAKWCPSLGSSYDRSTLLCEAVARRLFPRGSSPELADDLPDEPYAYRARERLRRTALVPLRRALQLPEVFMSARAWESVVYTRVASVAMKNYQAVFLKHDAERFNAYLADVKSSKKRIAAGALLPHQIIESLGEDGDGAGTGVADMQWRRMVDDMRALGKLTNCLAVCDVSGSMSGLPMDVCVALGLLVSELTDDPWSGRVITFSERPEIHLITGDTLSEKVGFMRAMDWGMNTNFQAVFDKILEVAVGAGLPPERMVRRVFVFSDMEFDQASAHPWETDYEAIVRKFSEAGYGSAVPEIVFWNLAYSKAVPVMSGQKGVALVSGFSKNLLKLFLDGGGIVTPRTIMEKAIVGPEYDKLTVFD

SEQ ID NO: 4040 - protein, 364 aa, Triticum aestivum
MGARSTATAGEAVARRGGRKKGAMAPSVGGVEAASAAAAMAGGRRSRAPPRLVGYEELPEYLKDNEYIRGHYRVEWPIRDALLSAFSWHNETLNVWTHLGGFLLFLALAVAGGGPEAAHDAAPGIMRFVVGSANSSWKSDQSGLPGHDAAAAVLGGHGVPRWPRMVFLVGAMACLAISATAHLLACHSRRATVVFWQLDYAGISIMIVASFVPPVYYAFLCHPPARVAYLSAITVLGALVVAVLLSPSCSSPRYRRLRATLFLAMGMSGVIPAVHALWVNWGHAACYLALGLEVAMGLAYAVGAWFYVSRVPEKWRPGVFDVVGHSHQIFHVFVLVGAITHYVAVAVLLDWREKAAVSCGGTAS

SEQ ID NO: 4041 - protein, 360 aa, Leymus cinereus x Leymus triticoides
  misc_feature (7)..(7): Xaa can be any naturally occurring amino acid
  misc_feature (18)..(18): Xaa can be any naturally occurring amino acid
  misc_feature (28)..(28): Xaa can be any naturally occurring amino acid
  misc_feature (36)..(36): Xaa can be any naturally occurring amino acid
  misc_feature (117)..(117): Xaa can be any naturally occurring amino acid
  misc_feature (135)..(135): Xaa can be any naturally occurring amino acid
  misc_feature (141)..(141): Xaa can be any naturally occurring amino acid
  misc_feature (148)..(148): Xaa can be any naturally occurring amino acid
  misc_feature (152)..(152): Xaa can be any naturally occurring amino acid
  misc_feature (155)..(155): Xaa can be any naturally occurring amino acid
  misc_feature (220)..(220): Xaa can be any naturally occurring amino acid
  misc_feature (223)..(223): Xaa can be any naturally occurring amino acid
  misc_feature (238)..(238): Xaa can be any naturally occurring amino acid
  misc_feature (242)..(242): Xaa can be any naturally occurring amino acid
  misc_feature (275)..(275): Xaa can be any naturally occurring amino acid
  misc_feature (341)..(341): Xaa can be any naturally occurring amino acid
MGARSTXTAGEAVARRGXKKKGAMAPSXGGVEAAAXAGGRRSRAPPRLVGYEELPEYLKDNEYIRGHYRVEWPIRDALLSAFSWHNETLNVWTHLGGFLLFLALAVAGGGSEAAHEXAPGIMRFVVGSANSSWKXDHSGLXSHDAAAXVLGXHGXPRWPRMVFLVGAMACLAISATAHLLACHSRRATVVFWQLDYAGISIMIVASFVPPVYYAFLCHPXARXAYLSAITVLGALVVXVLLXPSCSSPRYRRLRATLFLAMGMSGVIPAVHALWXNWGHAACYLALGLEVAMGLAYAVGAWFYVSRVPEKWRPGVFDVVGHSHQIFHVFVLVGAITHYVAXAVLLDWREKAAVSCGGTTS

SEQ ID NO: 4042 - protein, 366 aa, Brachypodium distachyon
MGARSGAAAAAAAARRSGKKAEAASASSAMAPVGGVESAAAAAGGRSRRPPRLVGYEELPEFLKDNEYIRGHYRAEWPLRDALLSAFAWHNETLNVWTHLGGFLLFLALAVAGGGKEAAHEVAPGIMRFVVGSANSSWKSDHSGLAGSAHGEAAASAELGVPRWPRMVFLVGAMACLATSSAAHLLACHSRRATVVFWQLDYAGISVMIVASFVPPVYYAFLCHRAARVAYLSAIAALGALVVAVLLSPSCSSPRYRRLRAALFLAMGLSGVVPALHALWINWGHAACYLALGLEVAMGLAYAVGAWFYVSRVPEKWRPGVFDVVGHSHQIFHVFVLVGAVTHYVAVAVLLDWREKVAVACGGTTP

SEQ ID NO: 4043 - protein, 346 aa, Sorghum bicolor
MGAATAPTKRSRGRSKRQQAMMARAGSGSEQARRRPRLVGYEELPEYLKDNEYIRGHYRAEWPIRDALLSAFAWHNETLNVWTHLGGFLFFLALAVAGGWTEAADEAAPGIMRFVVRSDNASWNSQHSGLPRHDAGASLSGVPRWPRMVFLVGAMSCLAISATAHLLACHSRRASVVFWQLDYAGISVMIVASFVPPVYYAFLCHPPARVAYLSAITALGALVVAALLSPSCSSPRYRRLRAALFLAMGLSGVVPALHALWLNWGHAACYLALGLEVAMGLAYATGAWFYVSRVPEKWRPGVFDVVGHSHQIFHVLVLVGAVTHYVAVAVLIHWREKMAVTCGAAS

SEQ ID NO: 4044 - protein, 119 aa, Secale cereale
MAGGKEPIEVKFRLFDGTDIGPSKYDPATTVSALKDFILARWPQDKEITPKTVNDLKLINGGKILENNRTLAESRVTIGEVPGGVITMHVVVRPPQVDKNREKQLGNSPKQNRCGCTIL

SEQ ID NO: 4045 - protein, 119 aa, Avena sativa
MAGGKEPIEVKFRLFDGTDIGPSKYDPATTVSALKDFILARWPQDKEITPKTVNDLKLINGGKILENSRTLAESRVTIGEVPGGVITMHVVVRPPQADKNREKQLGNSPKQNRCGCTIL

SEQ ID NO: 4046 - protein, 112 aa, Lolium multiflorum
MAGGKEPIEVKFRLFDGTDIGPSKYDPATTVSALKDFILARWPQDKEITPKTVNDLKLINGGKILENSRTLAESRVTIGEVPGGVITMHVVVRPPQADKNQKQLGNSPKQNR

SEQ ID NO: 4047 - protein, 119 aa, Brachypodium distachyon
MAGGKEPIEVKFRLFDGTDIGPSKYDPSTTVSALKDFILARWPQDKEINPKTVNDLKLINAGRILENNRTLAESRVPVGEVPGGVITMHVVVRPPQADKNSAKQLANSPKQNRCGCTIL

SEQ ID NO: 4048 - protein, 119 aa, Oryza sativa
MAGGKEPIEVKFRLFDGTDIGPSKYDPSTTVSALKEFILARWPQDKEITPKTVNDLKLINAGRILENNRTLAESRVPVGEVPGGVITMHVVVRPPQPDKNSEKQLANSPKQNRCGCTIL

SEQ ID NO: 4049 - protein, 118 aa, Cynodon dactylon
MAGGKEPIEVRFRLFDGTDIGPSKYDPSTTVSALKEFILARWPQDKDIVPKTVNDLKLINAGRILENNRTLAESRVPVGEVPGTVITMHVVVRPPQVDKNKKQLANSPKQNRCGCTIL

SEQ ID NO: 4050 - protein, 119 aa, Unknown
  Sequence found in Organisms: Pennisetum glaucum, Setaria italica, Panicum virgatum
MAGGKEPIEVRFRLFDGTDIGPTKYDPSTTVSALKEFILARWPQDKDIAPKTVNDLKLINAGRILENNRTLAESRVPVGEVPGGVITMHVVVRPPQADKNSEKQLANSPKQNRCGCTIL

SEQ ID NO: 4051 - protein, 119 aa, Zea mays
MAGGKEPIEVRFRLFDGTDIGPTKYDPSTTVSSLKEFILARWPQDKDITPKTVNDLKLINAGRILENNRTLAESRVPVGEVPGGVITMHVVVRPPQADKNSEKQLANSVKQNRCGCTIL

SEQ ID NO: 4052 - protein, 119 aa, Sorghum bicolor
MAGGKEPIEVRFRLFDGTDIGPTKYDPSTTVSSLKEFILARWPQDKDVAPKTVNDLKLINAGRILENNRTLAESRVPVGEVPGGVITMHVVVRPPQADKNSEKQLANSPKQNRCGCTIL

SEQ ID NO: 4053 - protein, 119 aa, Zea mays
MASGKEPIEVRFRLFDGTDIGPTKYDPSTTVSSLKEFILARWPQDKDIAPKTVNDLKLINGGRILENNRTLAESRVPVGEIPGGVITMHVVVRPPQADKNSEKQLANSPKQNRCGCTIL

SEQ ID NO: 4054 - protein, 511 aa, Hordeum vulgare
MAGGKEPIEVKFRLFDGTDIGPSKYDPATTVSALKDFILARWPQDKEITPKTVNDLKLINGGKILENNRTLAESRVTIGEVPGGVITMHVVVRPPQVDKNRGIADNFTPSLSHCVPGSEVFADSSTSCTHHCMIQILSRIATRSPRRAISASNPCSSKLHRAEFSCWDPAYLGNSTVSPSCTMRSGDGNSDGQDTPLAEGKDHGCSPGVQSTPDIEKKYVHRVYDAIAPHFSSTRFAKWPKVAGFLNALRPGSVVLDAGCGNGKYLGFNPECFYIGCDISPPLIEICAGRGHEVLVADAVNLPYRENVADAAISIAVLHHLSTEDRRRKAIQELIRVVKRGGLVLITVWAVEQEDRSLLNKWTPLCDKYNEEWVDPSSPMVRNKSATMLDSIEETDEDTGAVKQMDDRLKNSFDGLEDKTLIMDEHDKTQQEYFVPWHLPFHRAEIGGASAAALQNGLAKKDDKKGTVVYNRYYHIFVEGELQRLVAGMKNAAIADQFYDKSNWCIVLEKL

SEQ ID NO: 4055 - protein, 118 aa, Brachypodium distachyon
MAGGKEPIEVKFRLFDGTDIGPSKYDPSTSVTSLKEFILARWPQDKEVVPKTVNDVKLINAGRILENNKTLAESRVPVGEVPGGVITMHVVVRPPQSDKSEKQLSNSPKQNRCGCTIL

SEQ ID NO: 4056 - protein, 118 aa, Unknown
  Sequence found in Organisms: Secale cereale, Triticum aestivum
MAGGKEPIEVKFRLFDGTDIGPNKYDPATTVTALKEFVLARWPQDKDIIPKTLNDVKLINAGRILENNKTLAESRVPVGEVPGGVITMHVVVRPPQSDKSDKHLSNSPKQNRCGCTIL

SEQ ID NO: 4057 - protein, 118 aa, Hordeum vulgare
MAGGKEPIEVKFRLFDGTDIGPNKYDPATTVTALKEFVLARWPQDKDIVPKTLNDVKLINAGRILENNKTLAESRVPVGEVPGGVITMHVVVRPPQSDKSDKHLSNSPKQNRCGCTIL

SEQ ID NO: 4058 - protein, 99 aa, Secale cereale
MAGGKEPIEVKFRLFDGTDIGPSKYDPATTVSALKDFILARWPQDKEITPKTVNDLKLINGGKILENNRTLAESRVTIGEVPGGVITMHVVVRPPQVDK

SEQ ID NO: 4059 - protein, 118 aa, Pseudoroegneria spicata
MAGGKEPIEVKFRLFDGTDIGPNKYDPATTVTALKEFVLARWPQDKDIVPKTLNDVKLINAGRILENNKTLAESRVPVGDVPGGVITMHVVVRPPQSDKSDKHLSNSPKQNRCGCTIL

SEQ ID NO: 4060 - protein, 118 aa, Avena sativa
MAGGKEPIEVKFRLFDGTDIGPNKYDPSTTVTALKEFVLARWPQDKDVIPKTLNDVKLINAGRILENNKTLAESRVPVGEVPGGVITMHVVVRPPQSDKSEKHLSNSPKQNRCGCTIL

SEQ ID NO: 4061 - protein, 118 aa, Pennisetum glaucum
MAGGKEPIEVKFRLFDGTDIGPSKYDPNTTVAALKEFVLSRWPQDKEIVPKTVNDVKLINAGRILENSKTLAESRVPVGEVPGSVITMHVVVRPPQSNKSEKQQSNSPKQNRCGCTIL

SEQ ID NO: 4062 - protein, 118 aa, Sorghum bicolor
MAGGKEPIEVKFRLFDGTDIGPSKYDPNTTVTALKEFVLARWPQDKEIVPKTVNDVKLINAGRILENSKTLAESRVPVGEVPGSVITMHVVVRPPQSNKSEKQQSNSPKPNRCGCTIL

SEQ ID NO: 4063 - protein, 117 aa, Setaria italica
MAGGKEPIEVKFRLFDGTDIGPSKYDPNTTVAALKEFVLARWPQDKVVPKTVNDVKLINAGRILENSKTLAESRVPVGEVPGSVITMHVVVRPPQSNKSEKQQSNSPKQNRCGCTIL

SEQ ID NO: 4064 - protein, 118 aa, Sorghum bicolor
MADGKEPIEVKFRLFDGTDIGPSKYDPNTTVTALKEFVLARWPQDKEIVPKTVNDVKLINAGRILENSKTLAESRVPVGEVPGSVITMHVVVRPPQSNKSEKQQSNSPKPNRCGCTIL

SEQ ID NO: 4065 - protein, 118 aa, Panicum virgatum
  misc_feature (29)..(29): Xaa can be any naturally occurring amino acid
  misc_feature (40)..(40): Xaa can be any naturally occurring amino acid
MAGGKEPIEVKFRLFDGTDIGPSKYDPSXTVAALKEFVLXRWPQDKEIVPKTVNDVKLINAGRILENSKTLAESRVPVGEVPGSVITMHVVVRPPQSNKSEKQQSNSPKQNRCGCTIL

SEQ ID NO: 4066 - protein, 117 aa, Setaria italica
MAGGKEPIEVKFRLFDGTDIGPSKYDPNTTVAALKEFVLARWPHDKVVPKTVNDVKLINAGRILENSKTLAESRVPVGEVPGSVITMHVVVRPPQSNKSEKQQSNSPKQNRCGCTIL

SEQ ID NO: 4067 - protein, 118 aa, Zea mays
MAGVKEPIEVKFRLSDGTDIGPSKYDPNTTVAALKEFVLARWPQDKEIAPKTVNDVKLINVGRILENSRTLAESRVPVGEVPGSVITMHVVVRPPQSKNSEKQQSNSPKPNRCGCTIL

SEQ ID NO: 4068 - protein, 112 aa, Saccharum officinarum
SASVLALPARISGSPFLHPLNSCADSLPCPGGALLPVGILEEEGLVGGGRRPRSGRGDGRREGADRGEVPAVRRHRHRAQQVRPQHHRRRAQGFVLARWPQDKKIVPKTAMM

SEQ ID NO: 4069 - protein, 118 aa, Elaeis guineensis
MAGDDLIELKFRLFDGTDIGPSKYDPSTTVASLKETILSRWPQDKEIAPKTINDLKLINGGKILENNRTLAESGVPVGELPGGVITMHVVVRPPQLDKNNEKQLANAPKQNRCACTIL

SEQ ID NO: 4070 - protein, 241 aa, Triticum aestivum
MEALGLLGRACRLGHFRRRSTATPPPPPPRSNSKRCRAVRAGARAASSSAPRAMEAKREEPRVVTLRPVEATPESFAPFGQVIAASPDGDQFGPHDAQLDLSRGIPRFYIMRLESRPLKFSSITHHASVTQCLGSIGGQDWYLGVAKPSIVDGATEQSGGGSAVQSRAGHFYLPPDPSEVCVFRVSGPKFLKLHAGTWHAGPLFKADAVDFYNLELSNTNIVDHTTHYFKKQDGVTFVIED

SEQ ID NO: 4071 - protein, 189 aa, Avena sativa
MEAKLEEPRVVKLRAVEATPESFAPFGQVIAASPDGDQFGPHDAQLDLSRGIPRFYIMRLESKPLKFSSITHHASVTQCLGSIGGQDWYLGVAKSSIVDGAPPEQSGGRSPVQSRAGHFYLPPDPAEVCVFRVSGPKFLKLHAGTWHAGPLFKADAVDFYNLELSNTNVVDHTTHYFKKQDGVTFVIED

SEQ ID NO: 4072 - protein, 189 aa, Triticum aestivum
MEAKREEEPRVMTLRPVEATQESFAPFGQVIAASPDGDQFGPHDAQLDLSRGIPRFYIMRLESRPLKFSSITHHASVTQCLGSIGGQDWYLGVAKPSIVDGQSGQDRGRSLVQSRAGHFYLPPDPSEVCVFRVSGPKFLKLHAGTWHAGPLFKADAVDFYNLELSNTNIVDHTTHYFKKHDGVTFVIDD

SEQ ID NO: 4073 - protein, 272 aa, Pseudoroegneria spicata
  misc_feature (21)..(21): Xaa can be any naturally occurring amino acid
MHHDPNPFDEGTAGDENPFSXGGGRGGKQQYGFRPTEPVGFGGGGSRGDATVDVPLDNMGDSNGKARELSSWESDLRRREADIKRREESLKNAGVPMEEKNWPPFFPIIHHDIANEIPANVQKLQYLAFASWLGIVLCLSWNFIAVIVCWIKEGDSKLFFLATIYALLGIPLSYLMWYRPLYRAMRTNSAFSFGWFFLCYLIHIGFCIIAAIAPPIVFQGKSLTGILAAIDTFSEHLIIGIFYFVGFALFCLETLLSIGVLQKVYMYFRGHK

SEQ ID NO: 4074 - protein, 272 aa, Triticum aestivum
MHHDPNPFDEGTAGDENPFSNGGGRGGKQQHGFRPTEPVGFGGGGSRGDATVDVPLGNMGDSNGKARELSSWESDLRRREADIKRREESLKNAGVPMEEKNWPPFFPIIHHDIANEIPANVQKLQYLAFASWLGIVLCLSWNFIAVIVCWIKEGDSKLFFLATIYALLGIPLSYLMWYRPLYRAMRTNSAFSFGWFFLCYLIHIGFCIIAAIAPPIVFQGKSLTGILAAIDTFSEHLIIGIFYFVGFALFCLETLLSIGVLQKVYMYFRGHK

SEQ ID NO: 4075 - protein, 272 aa, Triticum aestivum
MHHDPNPFDEGTAGDENPFSNGGGRGGKQQHGFRPTEPVGFGGGGSRGDATVDVPLGNMGDSNGKARELSSWESDLRRREADIRRREESLKNAGVPMEEKNWPPFFPIIHHDIANEIPANVQKLQYLAFASWLGIVLCLSWNFIAVIVCWIKEGDSKLFFLATIYALLGVPLSYLMWYRPLYRAMRTNSAFSFGWFFLCYLIHIGFCIIAAIAPPIVFQGKSLTGILAAIDTFSEHVIIGIFYFVGFALFCLETLLSIGVLQKVYMYFRGHK

SEQ ID NO: 4076 - protein, 72 aa, Brachypodium distachyon
MHHDPNPFDEGGAEDNPFSNGGGRGGRQQYGFRPSEPVGFGGGRGDATVDVPLDNMGARMARRGSSRRGNQI

SEQ ID NO: 4077 - protein, 262 aa, Secale cereale
TAGDENPFSNGGGRGGKKQYGFRPTEPVGFGGGGGSRGDATVDVPLGNMGDSNGKARELSSWESDLRRREADIKRREESLKNAGVPMEDKNWPPFFPIIHHDIANEIPANVQKLQYLAFASWLGIVLCLSWNFIAVIVCWIKEGDSKLFFLATIYALLGIPLSYLMWYRPLYRAMRTNSAFSFGWFFLCYLIHIGFCIIAAIAPPIVFQGKSLTGILAAIDTFSEHLIIGIFYFVGFALFCLETLLSIGVLQKVYMYFRGHK

SEQ ID NO: 4078 - protein, 271 aa, Brachypodium distachyon
MHHDPNPFDEGGAEDNPFSNGGGRGGRQQYGFRPSEPVGFGGGRGDATVDVPLDNMGTQGSNGKARELSSWESDLKRREADIKRREESLKNAGVPMEDKNWPPFFPIIHHDIANEIPANVQKLQYLAFASWLGIVLCLSWNFIAVIVCWIKEGDSKLFFLATIYALLGIPLSYLMWYRPLYRAMRTNSAFSFGWFFLCYLIHIGFCIIAAIAPPIVFQGKSLTGILAAIDTFSEHVIIGIFYFVGFALFCLETLLSIGVLQKVYMYFRGHK

SEQ ID NO: 4079 - protein, 271 aa, Sorghum bicolor
MHHDPNPFDEGGAEDNPFSNGGGGGGKQQYGFRPTEPVGFGGAGRGGDAVVDVPLETMGDSKSKSRELSSWESDLKRREADIKRREEALKNAGVPMEEKNWPPFFPIIHHDIANEIPANVQKLQYLAFASWLGIVLCLSWNFIAVIVCWIKEGDSKLFFLATIYALLGIPLSYLIWYRPLYRAMRTNSAFSFGWFFLCYLIHIGFCIIAAIAPPIVFHGKSLTGILAAIDTFSEHVIIGIFYFVGFALFCLETLLSIGVLQKVYMYFRGNK

SEQ ID NO: 4080 - protein, 272 aa, Panicum virgatum
MHHDPNPFDEGSADDNPFSNGGGGGGGGKQQYGFRPTEPVGFGSAGRGDAVVDVPLDNMGDSKGKARELSSWESDLKRREADIKRREEALKNAGVPMEEKNWPPFFPIIHHDIANEIPANVQRLQYLAFASWLGIVLCLSWNFIAVIVCWIKEGDSKLFFLATIYALLGIPLSYLIWYRPLYRAMRTNSAFSFGWFFLCYLIHIGFCIIAAIAPPIVFHGKSLTGILAAIDTFSEHIIIGIFYFVGFGLFCLETLLSIAVLQRVYMYFRGNK

SEQ ID NO: 4081 - protein, 270 aa, Setaria italica
MHHDPNPFDEGAADDNPYSNGGGGGGKQQYGFRPTEPIGFGGAGRGDAVVDVPLDTMGDSKGKARELSSWESDLKRREADIKRREESLKNAGVPMEEKNWPPFFPLIHHDIANEIPANVQRLQYLAFASWLGIVLCLSWNFIAVIVCWIKEGDSKLFFLATIYALLGIPLSYLIWYRPLYRAMRTNSAFSFGWFFLCYLIHIGFCIIAAIAPPIVFHGKSLTGILAAIDTFSEHIVIGIFYFVGFGLFCLETLLSIAVLQRVYMYFRGNK

SEQ ID NO: 4082 - protein, 273 aa, Oryza sativa
MHHDPNPFDEGNADDNPFSNGGGGGGGGGSRQQYGFRPTEPAGFGAGRGDATVDVPLDTMGDSKSKARELSSWETDLKRREADIKRREEALRNAGVPMEDKNWPPFFPIIHHDIANEIPANLQKLQYLAFASWLGIVLCLSWNFIAVIVCWIKEGDSKLFFLATIYALLGIPLSYLIWYRPLYRAMRTNSAFSFGWFFLCYLIHIGFCIIAAIAPPIVFHGKSLTGILAAIDTFSEHVIIGIFYFVGFALFCLETLLSIGVLQRVYMYFRGNK

SEQ ID NO: 4083 - protein, 285 aa, Saccharum officinarum
MHHDPNPFDEGSADDNPFSNGGGGGGKQQYGFRPTEPVGFGGAGRGDAVVDVPLETMGDSKSKARELSSWESDLKRREADIKRREEALKNAGVPMEEKNWPPFFPIIHHDIANEIPANVQKLQYLAFASWLGIVLCLSWNFIAVIVCWIKEGDSKLFFLATIYALLGIPLSYLMWYRPLYRAMRTNSAFSFGWFFLCYLIHIGFCIIAGIAPPIVFHGKSLTGILAAIDTFSEHVIIGDLYLVGVCTVLSWKPGEHGGSSKSVHVLQRGTIEPGLIENLHFLRKW

SEQ ID NO: 4084 - protein, 257 aa, Pennisetum glaucum
MHHDPNPFVGGGAKQQYGFRPTEPVGFGGAGRGDAVVDVPLDTMGDSKGKARELSSWESDLKRREADIKRREEALKNAGVPMEEKNWPPFFPLIHHDIANEIPANVQKLQYLAFASWLGIVLCLSWNFIAVIVCWIKEGDSKLFFLATIYALLGIPLSYLIWYRPLYRAMRTNSAFSFGWFFLCYLIHVGFCIIAAIAPPIAFHGKSLTGILAAIDTFSEHIIIGIFYFVGFGLFCLETLLSIAVLQRVYMYFRGNK

SEQ ID NO: 4085 - protein, 274 aa, Sorghum bicolor
MHHDPNPFDDGADENPFSNGGGGARGGGVKSQYGFRPAEPAGFGGGGGRGDATVDIPLDTMNDSKGKAKELSQWESDLRRRESDIRRREEALKSAGVPMEDKNWPPFFPIIHHDIANEIPANAQKLQYLAFASWLGIVLCLFWNFIAVIVCWIRGGDSKLFFLATIYGMLGIPLSYLMWYRPLYRAMRTDSAFSFGWFFLCYLLHIGFCIFAAIAPPIIFRGKSLTGILAAIDTFSDHAIVGIFYFVGFALFCLETLVSIWVLQKVYMYFRGHK

SEQ ID NO: 4086 - protein, 273 aa, Saccharum officinarum
MHHDPNPFDEGADENPFSNGGGGARGGGVKSQYGFRPAEPAGFGGGGRGDATVDIPLDTMNDSKGKAKELSQWESDLRRRESDIRRREEALKSAGVPMEDKNWPPFFPIIHHDIANEIPANAQKLQYLAFASWLGIVLCLFWNFIAVIVCWIRGGDSKLFFLATIYGMLGIPLSYLMWYRPLYRAMRTDSAFSFGWFFLCYLLHIAFCIFAAIAPPVVFRGKSLTGILAAIDTFSDHAIVGIFYFVGFALFCLETLVSIWVLQKVYMYFRGHK

SEQ ID NO: 4087 - protein, 272 aa, Zea mays
MHHDPNPFDEGADENPFSNGGGGARGGGVKPQYGFRPTEPAGFGGGRGDATTDIPLDTMNDSKGKAKELSQWESDLRRRESDIRRREEALKSAGVPMEDKNWPPFFPIIHHDIANEIPANAQKLQYLAFASWLGIVLCLFWNFIAVIVCWIRGGDSKLFFLATIYGMLGIPLSYLMWYRPLYRAMRTDSAFSFGWFFLCYLLHIGFCIFAAIAPAVVFRGKSLTGILAAIDTFSDHAIVGIFYFVGFALFCLETLVSIWVLQKVYMYFRGHK

SEQ ID NO: 4088 - protein, 275 aa, Panicum virgatum
MHHDPNPFDEGADDNPFSNGGGGGAGARGGGGKSQFGFRPAEPVGFGGGRGDATVDIPLDTMNDSKGKAKELSQWESDLRRREADIRRREEALKSAGVPMEDKNWPPFFPIIHHDIANEIPANAQKLQYLAFASWLGIVLCLFWNFIAVIVCWIRGGDSKLFFLATIYGMLGIPLSYLMWYRPLYRAMRTDSAFSFGWFFLCYLLHIGFCIFAAIAPPIIFRGKSLTGILAAIDTFSDHAIVGIFYFVGFALFCLETLVSIWVLQKVYMYFRGHK

SEQ ID NO: 4089 - protein, 259 aa, Zea mays
PTVTVASQNGGAGGGKQQYGFRPTEPVGFGGASRGDAVVDVPLETMGDSRSKVKELSSWESDLKRREADIKRREEALKNAGVPMEEKNWPPFFPIIHHDIANEIPANVQKLQYLAFASWLGIVLCLSWNFVAVIVCWIKEGDSKLFFLATIYALLGIPLSYLIWYRPLYRAMRTNSAFSFGWFFLCYLIHIGFCIIAAIAPPIVFHGKSLTGILAAIDTFSEHVIIGIFYFVGFALFCLETLLSIGVLQKVYMYFRGNK

SEQ ID NO: 4090 - protein, 276 aa, Pennisetum glaucum
MHHDPNPFDEGADDNPFSNGGGGGGGGARGGGGKSQFGLRPAEPVGFGGGRGDATVDIPLDNMNDSKGKAKELSQWESDLRRRDADIRRREEALRSAGVPMEDKNWPPFFPIIHHDIANEIPANAQKLQYLAFASWLGIVLCLFWNFIAVIVCWIRGGDSKLFFLATIYGMLGIPLSYLMWYRPLYRAMRTDSAFSFGWFFLCYLLHIGFCVLAAIAPPIVFRGKSLTGILAAIDTFSDHAIVGIFYFVGFALFCLETLVSIWVLQKVYMYFRGHK

SEQ ID NO: 4091 - protein, 275 aa, Setaria italica
MNHDPNPFDEGADDNPFSNGGGGGGGARGGGGKSQFGFRPAEPVGFGGGRGDATVDIPLDTMNDSKGKAKELSQWESDLRRRDADIRRREEALRSAGVPMEDKNWPPFFPIIHHDIANEIPANAQKLQYLAFASWLGIVLCLFWNFIAVIVCWIRGGDSKLFFLATIYGMLGIPLSYLMWYRPLYRAMRTDSAFSFGWFFLCYLLHIGFCVFAAIAPPIIFRGKSLTGILAAIDTFSDHAIVGIFYFVGFALFCLETLVSIWVLQKVYMYFRGHK

SEQ ID NO: 4092 - protein, 274 aa, Brachypodium distachyon
MHRDPNPFDEGADENPFSNGGGRGAAAAGGKSKFQFRPAEPAGFGGGGNSDAAVDIPLDNMNDSNGKAGELSQWQADLKRREADIKRREEALKSAGVPMEDKNWPPFFPIIHHDIANEIPANAQRLQYLAFASWLGIVLCLFWNFIAVTVCWIRGGDSKLFFLATIYGMLGIPLSYLMWYRPLYRAMRTDSAFSFGWFFLCYMLHIGFCIIAAIAPPIVFRGKSLTGILAAIDTFSDHALVGIFYFVGFALFSLETVVSIWVLQRVYMYFRGHK

SEQ ID NO: 4093 - protein, 102 aa, Secale cereale
MDRVGSGEKHLEDCTVANALGTWVFSVAGALLAIPVGIKRKSFAPLVFFGTTGTMLDIIMGISQCEREHAERQMKLLEAQNLATNASVEGESLTDSFANVDK

SEQ ID NO: 4094 - protein, 102 aa, Triticum aestivum
MDRVGSGEKHLEDCTVANALGTWVFSVAGALLAIPVGIKRKSFAPLVFFGTTGTMLDIIMGISQCEREHAERQMKLLEAQNLAANASIEGESLTDSFANVDK

SEQ ID NO: 4095 - protein, 102 aa, Avena sativa
MERIGSGEKHLEDCTVSNALGTWVFSVAGALLAIPVGIKKKSFAPLVFFGTTGTMLDIIMGISQCEREHAERQMKLLEAQNLLANASVEGESLTESLANVDK

SEQ ID NO: 4096 - protein, 96 aa, Triticum aestivum
MDRVGSGEKHLEDCTVANALGTWVFSVAGALLAIPVGIKRKSFAPLVFFGTTGTMLDIIMGISQCEREHAERQMKLLEAQNLAMNASVDGESLTDK

SEQ ID NO: 4097 - protein, 102 aa, Brachypodium distachyon
MERVGSGEKQLEDCSVSNALGTWFFSVAGALLAIPVGIKKKSLAPLVFFGTTGTMLDIIMGISQCEREHAERQMKLLEAQNLLANASVDGESSTESFTNVDK

SEQ ID NO: 4098 - protein, 101 aa, Sorghum bicolor
MDRVGGGEKQLEDCTVANALGTWFFSVAGALVAIPVGIKRKSLAPLVFFGTTGTMLDIITGISQCEREHAERQMKLLEAQKLSTDASAGGESSDSFGSADK

SEQ ID NO: 4099 - protein, 101 aa, Saccharum officinarum
MDRVGGGEKQLEDCTVANALGTWFFSVAGALVAIPVGIKRKSLAPLVFFGTTGTMLDIITGISQCEREHAERQMKLLEAEKLSANASAESESSDSFGSADK

SEQ ID NO: 4100 - protein, 101 aa, Setaria italica
MDRVGSGEKQLEDCTVANALGTWFFSVAGALVAIPVGIKKKSFAPLVFFGTTGTMLDIIMGISQCEREHAERQMKLLEAQKLPADASDGIESAESSGNADK

SEQ ID NO: 4101 - protein, 104 aa, Pennisetum glaucum
MDRVGSGEKQLEDCTVANALGTWFFSVAGALVAIPVGIKKKSLAPLVFFGTTGTMLDIIMGISQCEREHAERQMKLLEAQKLSADASAASAGIESTESFGNADK

SEQ ID NO: 4102 - protein, 92 aa, Oryza sativa
MERVGGGEKQLEDCTVSNALGTWFFSVAGALVAIPVGIKKKSLAPLVFFGTTGTMLDIIMGISQCEREHAERQMKLLEAQNLSANASADGEN

SEQ ID NO: 4103 - protein, 97 aa, Pennisetum glaucum
GSGEKQLEDCTVANALGTWFFSVAGALVAIPVGIKKKSLAPLVFFGTTGTMLDIIMGISQCEREHAERQMKLLEAQKLSTDASAGIESAESFGNADK

SEQ ID NO: 4104 - protein, 101 aa, Panicum virgatum
MERVGGGEKQLEDCTVSNALGTWFFSVAGALVAIPVGIKKKSLAPLVFFGTTGTMLDIIMGISQCEREHAERQMKLLEAQKLSADVSAESGSSDSFGSVDK

SEQ ID NO: 4105 - protein, 369 aa, Triticum aestivum
MKRFFQPVLKDGSPAKKRPAGAATSDCVDGPAPTAADAGGDGPPGEEPRRFVTWNANSLLLRMKSDWPAFCQFVARVDPDVICVQEVRMPAAGSKGAPKNPSELKDDTTSSREEKQTVLRALSSSPFKDYRVWWSLSDSKYAGTAVFMKKKFEPKKVSFNLDRTSSKHDADGRVIIVEFESFLLLNTYAPNNGWKEEENSFQRRRKWDKRMLEFVQQVDKPLIWCGDLNVSHDEIDVSHPDFFSDAKLNGYIPPNKEDCGQPGFTLAERQRFGNILSQGKLVDAYRYLHKEKDMECGFSWSGNPVGKYRGKRMRIDYFVVSEGLKDRIVSCEMHGHGIELEGFYGSDHCPVSLELSKEAAEAPESKSSG

SEQ ID NO: 4106 - protein, 369 aa, Secale cereale
MKRFFQPVLKDGSPAKKRPAGAATSDCADGPAPTAADAGGEGPPGEEPRRFVTWNANSLLLRMKSDWSAFCQFVARVDPDVICVQEVRMPAAGSKGAPKNPSELKDDTTSSREEKQTVLRALSSSPFKDYRVWWSLSDSKYAGTAVLMKKKFEPKKVSFNLDRTSSKHDADGRVIILEFESFLLLNTYAPNNGWKEEENSFQRRRKWDKRMLEFVQQVDKPLIWCGDLNVSHDEIDVSHPDFFSDAKLNGYIPPNKEDCGQPGFTLAERQRFGNILSQGKLVDAYRYLHKEKDMECGFSWSGNPIGKYRGKRMRIDYFVVSEGLKDRIVSCEMHGHGIELEGFYGSDHCPVSLELSKEVAEAPESKSSG

SEQ ID NO: 4107 - protein, 368 aa, Triticum aestivum
MKRFFQPVLKDGSPAKKRPAGVATSDCADGPAPTAADAGGDGPPGEEPRRFVTWNANSLLLRMKSDWSAFCQFVARVDPDVICVQEVRMPAAGSKGAPKNPSELKDDTTSSREEKQTVLRALSSSPFKDYRVWWSLSDSKYAGTAVFMKKFEPKKVSFNLDRTSSKHDADGRVIIVEFESFLLLNTYAPNNGWKEEENSFQRRRKWDKRMLEFVQQVDKPLIWCGDLNVSHDEIDVSHPNFFSDAKLNGYIPPNKEDSGQPGFTLAERQRFGNILSQGKLVDAYRYLHKEKDMECGFSWSGNPIGKYRGKRMRIDYFVVSEGLKDRIVSCEMHGHGIELEGFYGSDHCPVSLELSKEAAEAPESKSSG

SEQ ID NO: 4108 - protein, 369 aa, Triticum aestivum
MKRFFQPVLKDGSPAKKRPAGAAISDCVDGRAPTAADAGGDGPPGEEPRRFITWNANSLLLRMKSDWPAFCQFVARVDPDVICVQEVRMPAAGSKGAPKNPSELKDDTTSSREEKQTVLRALSSSPFKDYRVWWSLSDSKYAGTAVFMKKKFEPKKVSFNLDRTSSKHDADGRVIIVEFESFLLLNTYAPNNGWKEEENSFQRRRKWDKRMSEFVQQVDKPLIWCGDLNVSHDEIDVSHPDFFSDAKLNGYIPPNKEDCGQPGFTLAERQRFGNILSQGKLVDAYRYLHKEKDMECGFSWSGNPVGKYRGKRMRIDYFVISEGLKDRIVSCEMHGHGIELEGFYGSDHCPVSLVLSKEAAEAPESKSSS

SEQ ID NO: 4109 - protein, 369 aa, Brachypodium distachyon
MKRFFQPVPKEGSPAKRRPSEVVASDCVDGPAATAAGAGGEGAPGQEPRRFMTWNANSLLLRMKSDWPAFCQFVSRLDPDVICVQEVRMPAAGSKGAPKNPSELKDDTSSSREEKQIVLRALSSSPFKDYRVWWSLSDSKYAGTAVFVKKMFEPKKVSFNLDRTSSKHESDGRVIIVEFESLLLLNTYAPNNGWKEEENSFQRRRKWDKRMFEFVQQVDKPFIWCGDLNVSHEEIDVSHPDFFSSAKLNGYIPPNKEDCGQPGFTLAERQRFGNILSQGKLVDAYRHLHKEKDMECGFSWSGNPIGKYRGKRMRIDYFIVSERLKDRLVSCEIHGHGIELEGFYGSDHCPVSLELSKDAAEAPGSQNSS

SEQ ID NO: 4110 - protein, 244 aa, Panicum virgatum
MKRFFQPVPKDGSPAKKRPTATTDSGDAPAAAGAGGEEGSPGEEPHKFVTWNANSLLLRMKSDWPAFSQFVARLDPDVICIQEVRMPAAGSKGAPKNPRELKDDTSSSRDEKQIVLRALSSSPFKDYCVWWSLSDSKYAGTAVFIKKKFEPKKVSFNLDRTSSKHETDGRVIIVEFESFLLLNTYAPNNGWKEEENSFQRRRKWDKRMLEFVQRVDKPLIWCGDLNVSHEEIDVSHPDFLSVLS

SEQ ID NO: 4111 - protein, 367 aa, Setaria italica
MKRFFQPVPKDGSSAKKRPAVATDSCDGPAATGAGGEEGSPGEEPCKFLTWNANSLLLRMKSDWPAFSQFVARLDPDVICVQEVRMPAAGSKGAPKNPSELKDDTNSSRDEKQVVLRALSSSPFKDYRVWWSLSDSKYAGTAMFIKKKFEPKKVSFNLDKTSSKHETDGRVIIVEFESFLLLNTYAPNNGWKEEENSFQRRRKWDKRMLEFVQCVDKPLIWCGDLNVSHEEIDVSHPDFFSSAKQNGYTPPNKEDCGQPGFTLAERRRFGNILSQGKLVDAYRHLHKEKDMDSGFSWSGHPIGKYRGKRMRIDYFIVSEQLKGRVISCEMHGRGIELEGFYGSDHCPVSLELSKAATEVPEPPKPSS

SEQ ID NO: 4112 - protein, 367 aa, Panicum virgatum
MKRFFQPVPKDGSPAKKRPTGATDSGNAPAAAGAGGEEGSPGEEPRKFLTWNANSLLLRMKSDWPAFSQFVARLDPDVICIQEVRMPAAGLKGAPKNPSELKDDTSSSRDEKQIVLRALSSSPFKDYRVWWSLSDSKYAGTAMFIKKKFEPKKVSFNLDRTSSKHEMDGRVIIVEFESFFVLNTYAPNNGWKEEEKSFQRRRKWDKRMLEFVQHVDKPLIWCGDLNVSHEEIDVSHPDFFISAKLNGYTPPNKEDCGQPGFTLAERHRFGNILSQGKLIDAYRHLHKEKDMDSGFSWSGHPIGKYRGKRMRIDYFIVSEQLKDRIISCEMHGRGIELEGFYGSDHCPVSLELSKAATEAPEPPRPSS

SEQ ID NO: 4113 - protein, 379 aa, Oryza sativa
MKRFFQPVPKDGSPAKKRPAAAAAASASDSDSLGGDAPAAAACAVGEGDSPPAPREEEPRRFVTWNANSLLLRMKSDWPAFCQFVSRVDPDVICVQEVRMPAAGSKGAPKNPGQLKDDTSSSRDEKQVVLRALSSPPFKDYRVWWSLSDSKYAGTAMIIKKKFEPKKVSFNLDRTSSKHEPDGRVIIAEFESFLLLNTYAPNNGWKEEENSFQRRRKWDKRMLEFVQQVDKPLIWCGDLNVSHEEIDVSHPDFFSSAKLNGYIPPNKEDCGQPGFTLSERRRFGNILSQGKLVDAYRYLHKEKDMDCGFSWSGHPIGKYRGKRMRIDYFLVSEKLKDQIVSCDIHGRGIELEGFYGSDHCPVSLELSEEVEAPKPKSSN

SEQ ID NO: 4114 - protein, 369 aa, Sorghum bicolor
MKRFFQPVAKDGSPSKKRQAAAAEPEGGPASAGAATGGDGEGRPAEEPRKFLTWNANSLLLRMKSDWPAFSQLVARLDPDVICVQEVRMPAAGSKGAPKNPSELKDDTSSSRDEKQVVLRALSTSPFKDYRVWWSLSDSKYAGTAMFIKKKFEPKKVSFNLDRTSSKHETDGRVIIAEFESFLLLNTYAPNNGWKEEENSFQRRRKWDKRMLEFVQHVDKPLIWCGDLNVSHEEIDVSHPDFFSSAKLNGYTPPNQEDCGQPGFTPAERRRFGNILFQGKLVDAYRHLHKEKDMDGGFSWSGHPIGKYRGKRMRIDYFLVSEQLKDRIVSCEMHGRGIELDGFYGSDHCPVTLELSKAVAEAAPEQPKP

SEQ ID NO: 4115 - protein, 373 aa, Zea mays
MKRFFQPVPKDGSPSKKRLAGAAEPGDGPTSAGAATGAGGDVEGRPTEEPFKFLTWNANSLLLRMKSDWPAFSQLVARLDPDVICVQEVRMPAAGSKGAPKNPSELKDDTSLSRDEKQVVLRALSASPFKDYRVWWSLSDSKYAGTAMFIKKKFEPKKVSFNLDRTSSKHEADGRVIIAEFESFLLLNTYSPNNGWKEEENAFQRRRKWDKRMLEFVQHVDKPLIWCGDLNVSHEEIDVSHPDFFSSAKLNGYTPPNKEDCGQPGFTPAERRRFGNILFQGKLVDAYRHLHKEKDIDGGFSWSGHPIGKYRGKRMRIDYFLVSEQLKDRIVSCEMHGRGIELDGFYGSDHCPVSLELSEAVAEEAPGQPKPSI

SEQ ID NO: 4116 - protein, 203 aa, Triticum aestivum
ARHLRGLRGRRDHRHRHVLRRRRQSLAPPDPLRLPLGLPQAHRGTGRRVAPSYGRAQNPVALLQLCVGRRCLVFQLLHADFVPRALHRFLANPDFRFVGVGVQDDADRLSNDYGLEVANAVDLRNLAADEMRRPWLRQAGLKGVAGVVMGANLNKPRRVRMGPWDACRLSQEQIQYASIDAFVLFEVGRKLLTGDYSSEEEDY

SEQ ID NO: 4117 - protein, 493 aa, Secale cereale
LVPWLACLVVAFLSFYLLSLLAHARSGLPPGPRPLPLIGSLHLLGDKPHRSLARLAKIYGPLMSIRLGAVTTVVVSSPAMAREFLQRHDSVLATRSVPDATGKHAAGSVPWLPPAPRWRALRKMMATELFAPHRLDALHHLRSDKVRELTDHVARLAREGTAVNVGRVAFTTSLNLISRTIFSVDLTSLDDMSSSKEFQEVITAIMEGLGTPNLSDFFPVLAPADLQGMRRRLARLFARLHAVFDAEVDQRLHGRDAGQPRKNDFLDVLLDVAAREDGKDLLDRETLRSHFTDLFAAGSDTSSSTVEWAMTELLQNPSSMAKVCDELAQVIGTRRNIEEADIVRLPYLQAVIKETFRLHPPAPLLLPRQPETTVKIAGCTIPKGSRVFINVWAIGRDKDVWTEPEKFMPERFLGSTIDFRGVDFELLPFGAGRRICPGMALAIRMVHVMLASLLNQFKWSLPIELERDGIDMEDQFGLTLAKVVPLCIIATPI

SEQ ID NO: 4118 - protein, 502 aa, Triticum aestivum
MEAMVAVAVLVPWLAWLIVSFLSLYLLSLLAHARSGLPPGPRPLPLIGSIHLLGDKPHRSLARLAKIHGPLMSIRLGTVTTVVVSSPAMAREFLQRHDSVLATRSVPDATGKHAVGSVAWLPPVPRWRALRKIMATELFAPQRLDALHHLRSDKVRELTDHVARLAREGTPVNIGRVAFTTSLNLVSRTIFSIDLTSLGDHGRSKEFHEVITGIMEGLGTPNVSDFFPVLAPADLQGMRWRLARLFARLHAVFDAEVDQRLRGRDAGQPRKNDYLDVLLDLAASEDRKDLLDRETLRSHFTDLFAAGSDTNSSTVEWAMTELLQNRSSMAKVCDELAQVIGVRKNTEEADIARLPYLQAVIKETLRLHPPAPLLLPRQAKTTVKIEGYTIPMDSRLFINVWAIGRDKDVWTKPQKFMPERFLGSTIDFRGMDFELLPFGAGRRICPGITLAIRMVHVMLASLLNQFRWSLPVEMEHDGIDMEDQFGITLAKVVPLCIIATPI

SEQ ID NO: 4119 - protein, 498 aa, Secale cereale
MVVAVLVPWLAWLIVSFLSLYLLSLLAHSRSGLPPGPRPLPLIGSIHLLGDKPHRSLARLAKIHGPLMSIRLGTVTTVVVSSPAMAREFLQRHDSVLATRSVPHATGKHAVGSVAWMPPTPQWRALRKIMATELFAPHRLDALHHLRSDKVRELTDHVARLAREGTAVNIGRVAFTTSLNLVSRTIFSIDLTSLGDHGRSKEFQEVITGIMEGLGTPNVSDFFPVLAPADLQGMRRRLARLFARLHAVFDAEVDQRLHDRDAGQPRKNDYLDVLLDVVTTVDGKVLLDRETLRSHFTDLFAAGSDTNSSTVEWAMTELLQNPSSMAKVCGELEQFIGSRKNIEEGDIARLPYLQAVIKETLRLHPPAPLLLPRQPGTTVKIEGYTIPTGSRLFINVWAIGRDKDVWTKPEKFMPERFLGSTVDFRGVDFELLPFGAGRRICPGITLAIRMVHVMLGSLLNQFKWSLPVEMEHDGIDMEDQFGITLAKVVPLCIMATPI

SEQ ID NO: 4120 - protein, 500 aa, Triticum aestivum
MVAVAVLVPWLAWLVVSLLSLYLLNLLNHARSGLPPGPRPLPLIGSLHLLGDKPHRSLARLARTHGAPLMSLRLGAVTTVVASSPAMAREFLQRHDAAFAARSVPDATGMHAAGSVPWLPPAPRWRALRKMMATELFAPHRLDALHHLRSEKVGELMDHVARLARDGKPVNVGRVAFTTSLNLLSRTIFSHDLTSLDDDSRSGEFQEVVTAIMEAVGTPNVSDFFPVLAPADLQGTRRRLARLFARLHVVFDAEVDQRLRARDAGQPRKNDFLDVLLDVAAREDGKDLLDRQTLRSLFTDLFAAGTDTSSSTVEWAMTELLQNPSSLAKACNELEQVIGPRRNIEEADIVRLPYMQAIIKETFRLHPPAPLLLPRQPEATLKIAGYTIPKGSRIFINVWAIGRDKDVWDEPEKFMPERFLGSTVDFRGADFELLPFGAGRRICPGMTLATRMVHLILASLLHQFKWSLPAELERDGIDMEDKFGLTLTKVVPLCIVATPV

SEQ ID NO: 4121 - protein, 453 aa, Triticum aestivum
MAPVAVLVPWLAWLVASFLSVYLLNLLARARSGLPPGPHPLPLIGSLHLLGDKPHRSLARLAKAHGPLMSLRLGAVTTVVVSSPAMARVFLQRHDSAFAARSVPDATGEHAAGSVAWLPPAPRWRALRKMMATELFAPHRLDALRHLRSEKVRELVDHVARLAREGAPVNVGRVAFTTSLNLLSRTIFSADLTSLDDRGRSEEFQQVVTAIMQAVGSPNVSDFFPLLAPADLQGTRRRLARLLARLHAVFDAEVDGRLRGRDAGQPRKNDFLDALLDVAAREDGKDLLDRQTLRSLFTDLFSAGSDTSSSTVEWAMTELLQNPSSMSSACNELAEVIGFKRNIEEDDIVRLPYLQAVIKETFRLHPPGPLLLPRKPERTVEIAGYTIPKDSRVFINVWAIGRDKDYGLSLRSLCQRGSWVQELTLGVLILSSFHLVLDVGSALECHWLLERCI

SEQ ID NO: 4122 - protein, 500 aa, Hordeum vulgare
MVAVAVLAPWLAWLVVSFVSLYLLNLLTHARSGLPPGPRPLPLIGSLHLLGDRPHRSLARLAMTHAAPLMSLRLGSVTTVVASSPAMARELLQRHDAAFSTRSVPDATGMHAAGSVPWLPPAPRWRALRKLMATELFAPHRLDALHHLRSGKVRELMDHVARLARDGKPVNVGRVAFTTSLNLLSRTIFSRDLTSLDDDNRSGEFQEVVTGIMEAVGTPNVSDFFPVLAPADLQGTRRRLARLFARLHVVFDAEVDQRLRRRDDGQPRKNDFLDVLLDVAAREDGKDLLDRPTLRSLFTDLFVAGSDTSSSTVEWAMSELLQNPSSLSKACNELEKVIGQRRNIEESDIVRLPYIQAIIKETFRLHPPAPLLLPRQPEATLKIAGYTIPKGSRVFVNVWAIGRDKDVWDEPEKFMPERFLGSTIDFRGVDFELLPFGAGRRICPGMTLAARMVHLMLASLLHQFKWSLPVELERDGIDMEDKFGLTLTKVVPLCIVATPV

SEQ ID NO: 4123 - protein, 499 aa, Hordeum vulgare
MASVAVLVPWLAWLAVSFLAVYLLSLIPHARSGLPPGPRPLPLIGSLHLLGDKPHRSLARLASTHGPLMSLRLGAVTTVVVSSPAMAREFLQRHDSAFAARSVPDATGDHAAGSVAWLPPSPRWRALRKVMATELFAPHRLDALRHLRSDKVRDLVDHVARLALEGAPVNVGRVAFTTSLNLLSRTIFSADLTSLDDRGRSDEFQQLVTAIMQAVGSPNVSDFFPLLAPADLQGTRRRLARLLARLHAVFDAEVDQRLHGRDAGEPKKNDFLDVLLDVAAREDGKDLLDRPTLRSLFTDLFSAGSDTSSTTVEWAMTELLQNPSSMSNACNELAEVIGFKRNIDEDDIVRLPYLQAVIKETFRLHPPGPLLLPRKPERTLEIAGYIIPEDSRVFINVWAIGRDKDVWIEPEKFMPERFLGSTIDFRGADFELLPFGAGRRICPGMPLAIRTVHLILASLLNQFKWSLPVELERDGIDMEEKFGISLTKVVPLCIVPTLV

SEQ ID NO: 4124 - protein, 89 aa, Secale cereale
MKGTKLAAILILQAVLVMGVLSHVNADFFPKCCNNCRSFSGVDVCDDAHPKCPAGCSACRVVTTNPQTWRCADMKATVDGTCGGPCKKY

SEQ ID NO: 4125 - protein, 101 aa, Secale cereale
MKGTKLAAILILQAVLVMGVLSHVNADFSQRAATTAGPLGVDVCDDAHPNVPRRLLGLPRGDHEPPNVALRRYEGHRRRHLRWALQKVLIGSCTYDMFRLK

SEQ ID NO: 4126 - protein, 61 aa, Secale cereale
MKGTKLAAILILQAVLVMGVLSHVNADFFPKCCNNCRSFSGVDVCDDAHPKCPAAARPAAW

SEQ ID NO: 4127 - protein, 100 aa, Secale cereale
KGTKLAAILILQAVLVMGVLSHVNAVFFPKCCNNCRSFSASTSATTPIPSARRLLGLPRGDHEPPNVALRRYEGHRRRHLRWALQKVLIGSCTYDMFRLK

SEQ ID NO: 4128 - protein, 89 aa, Festuca arundinacea
MKNTKLVAILVLQAVLVMGILSHVNADYFPPCCDNCRSFSGVDVCDDAHPQCPTGCSACRVVTTNPQTFRCADMKPTVDGTCGGPCKKY

SEQ ID NO: 4129 - protein, 89 aa, Pseudoroegneria spicata
MKNTKLAAILILQAVLVMGVLSHVNADFFPKCCNNCRSFSGVDVCDDAHPKCPKGCSACRVVTTNPQTWRCADMKNTVDGTCGGPCKKY

SEQ ID NO: 4130 - protein, 73 aa, Secale cereale
MKGTKLAAILILQAVLVMGVLSHVNVRLFPQVLQQLQVLLGLDVCDDAHPKCPAGCSACRVVTTTPKRGAAPI

SEQ ID NO: 4131 - protein, 90 aa, Secale cereale
MKSTKLAAILILQAVLVMGILSHVNADYFPKCCNNCRSFSGVDVCDDAHPQCPKGCSACRVVTPSPHKTFRCADMKSTVDGTCGGPCKKY

SEQ ID NO: 4132 - protein, 89 aa, Unknown
  Sequence found in Organisms: Setaria italica, Secale cereale, Triticum aestivum
MKGTKLAAILILQAVLVMGVLSHVNADYFPKCCNNCRSFSGVDVCDDAHPKCPKGCSACRVVSTSPEMWRCADMKSTVDGTCGGPCKKY

SEQ ID NO: 4133 - protein, 89 aa, Leymus cinereus x Leymus triticoides
MKSTKLAAILILQAVLVMGILSHVNADFFPKCCNKCRSFSGVDVCDDAHPKCPKGCSACRVVTTNPQTWRCADMKNTVDGTCGGPCKKY

SEQ ID NO: 4134 - protein, 90 aa, Secale cereale
MKSTKLAAILILQAVLVMGILSHVNADFFPKCCNNCRSFSGVDVCDDAHPQCPKGCSACRVVTPSPHKTFRCADMKSTVDGTCGGPCKKY

SEQ ID NO: 4135 - protein, 90 aa, Triticum aestivum
MKSTKLAAILILQAVLVMGILSHVNADYFPKCCNNCRSFSGVDVCDDAHPQCPKGCSACRVVTPSPHKTFRCADMKSTVDGTCGGPCKKH

SEQ ID NO: 4136 - protein, 75 aa, Secale cereale
MKSTKLAAILILQAVLVMGILSHVNADFFPKCCNNCRSFSGVDVCDDAHPHVPQGLLRLPRGDAEPPTRRSGALT

SEQ ID NO: 4137 - protein, 73 aa, Secale cereale
MKSTKLAAILILQAVLVMGNPLTRERRLFPQVLQQLQVLLGGRRLRRRPPPVPQGLLRLPRGDAEPPQDVPVR

SEQ ID NO: 4138 - protein, 94 aa, Secale cereale
FISNHEEHQARSDPDPPGRPGHGDPLTRERRLLPKCCNNCRSFSGVDVCDDAHPQCPKGCSACRVVTPSPHKTFRCADMKSTVDGTCGGPCKKY

SEQ ID NO: 4139 - protein, 89 aa, Secale cereale
MKSTKVAAILILQAVLVMGILSHVNADFFPKCCNNCRSFSGVDVCDDAHPKCPTGCSACRVVTTNPEMWRCADMKSTVDGTCGGPCKKY

SEQ ID NO: 4140 - protein, 89 aa, Triticum aestivum
MKGTKLAAILILQAVLVMGVLSHVNADFFPKCCNNCRSFSGVDVCDDAHPKCPKGCSACRVVSTSPEMWRCADMKSTVDGTCGGPCKKY

SEQ ID NO: 4141 - protein, 96 aa, Triticum aestivum
MKGTKLAAILILQAVLVMGVLSHVNADYFPKCCNNCRSFSGVDVCDDAHPKCPKGCSACRVVSTSPEMWRCAGYEIHRPTAPAVGPARITDRSMPT

SEQ ID NO: 4142 - protein, 560 aa, Triticum aestivum
MAAAAVASNGGAAPVPGRLASVYSEVQTSRIAHALPLPSVLRSHFTLADGPASTAAGSPDEIAKLFPCLYGQPSAAVVPSAEPVETKPLKIGVVLSGGQAPGGHNVICGIFDYLQERAKGSTMYGFKGGPAGVMKGKYVELTTDFVYPYRNQGGFDMICSGRDKIETPEQFQQAEDTVNRLDLDGLVVIGGDDSNTNACLLGEYFRGRNLKTRVIGCPKTIDGDLKCKEVPTSFGFDTACKIYSEMIGNVMTDARSTGKYYHFVRLMGRAASHITLECALQTHPNVALIGEEVAEKKETLKNVTDYITDVVCKRAELGYNYGVVLIPEGLIDFIPEIQKLIAELNEILAHDVVDEAGAWKSKLEPASRELFDFLPKTIQEQLLLERDPHGNVQVAKIETEKMLIAMVETELEKRRAAGKYSAHFRGQSHFFGYEGRCGLPTNFDSSYCYALGYGAGALLQFGKTGLISSVGNLAAPVEEWTVGGTALTALMDVERRHGKNKPVIKKAMVELDAAPFKKFASLRDEWASKNRYISPGPIQFSGPGSDASNHTLMLELGAEI

SEQ ID NO: 4143 - protein, 90 aa, Unknown
  Sequence found in Organisms: Hordeum vulgare, Triticum aestivum
MKSTKLAAILILQAVLVMGILSHVNADFFPKCCNNCRSFSGVDVCDDAHPQCPKGCSACRVVTPSPHKTFRCADMKSTVDGTCGGPCKKH

SEQ ID NO: 4144 - protein, 90 aa, Triticum aestivum
MKSTKLAAILILQAVLVMGILSHVNADYFPKCCNSCRSFSGVDVCDDAHPQCPKGCSACRVVTPSPHKTFRCADMKSTVDGTCGGPCKKH

SEQ ID NO: 4145 - protein, 90 aa, Hordeum vulgare
MKGTKLAAILILQAVLVMGILSHVNADFFPKCCNNCRSFSGVDVCDDAHPKCPKGCSACRVVTPSPHKTFRCADMKSTVDGTCGGPCKKH

SEQ ID NO: 4146 - protein, 90 aa, Avena sativa
MKNTKLVAILVLQAVLVMGILSHVNADYFPTCCDNCRSFSGVDVCDDAHPTCPTGCSACRVVQTTPTQTFRCADMKNTVDGTCGGPCTKY

SEQ ID NO: 4147 - protein, 74 aa, Triticum aestivum
MKGTKLAAILILQAVLVMGVLSHVNADYFPKCCNNCRSFSGVDVCDDAHPKCPKGCSACRVVSTSPEMWALRGI

SEQ ID NO: 4148 - protein, 89 aa, Triticum aestivum
MKGTKLAAILILQAVLVMGLLSHVNADFFPKCCNNCRSFSGVDVCDDAHPKCPQGCSACRVVSTSPEMWRCADMKSTVDGTCGGPCKKY

SEQ ID NO: 4149 - protein, 95 aa, Secale cereale
MKGTKLAAILILQAVLVMGVLSHVNADFFPKCCNNCRSFSGVDVCDDAHPKCPAGCSACRVVTTNPQTWRCADMKATVDGTCGGPCKKSDRFVHT

SEQ ID NO: 4150 - protein, 99 aa, Triticum aestivum
MKGTKLAAILILQAVLVMGVLSHVNADYFPKCCNNCRSFSGVDVCDDAHPKCPKGCSACRVVSNEPEMWRCADMKSTVDGPAVGLQEVLIGSCHMICSA

SEQ ID NO: 4151 - protein, 92 aa, Avena sativa
MKNTSTKLVAILVLQAVLVMGILSHVNADYFPTCCDNCRSFSGVDVCDDAHPTCPTGCSACRVVQTTPTQTFRCADMKNTVDGTCGGPCTKY

SEQ ID NO: 4152 - protein, 62 aa, Secale cereale
MKSTKVAAILILQAVLVMGILSHVNADFFPNVLQQLQVRSRGRRLRRRPLPTCPRAARRAAW

SEQ ID NO: 4153 - protein, 90 aa, Avena sativa
MKNTKLVAILLLQALLVMGILSHVNADYFPKCCNNCRSFSGIDVCDDAHPTCPKGCSACRTVTTSPKKTYRCADMKNTVDGTCGGPCKKY

SEQ ID NO: 4154 - protein, 90 aa, Avena sativa
MKNTKLVAVLLLQALLVMGILAHVNADYFPKCCNNCRSFSGVDVCDDTHPTCPKGCSACRAVTTSPKKTFRCADMKSTVDGTCGGPCKKY

SEQ ID NO: 4155 - protein, 90 aa, Avena sativa
MKNTKLVAVLLLQALLVMGVIAHVNADYFPKCCNNCRSFSGVDVCDDTHPTCPKGCSACRAVTTSPKKTFRCADMKSTVDGTCGGPCKKY

SEQ ID NO: 4156 - protein, 104 aa, Secale cereale
MKSTKVAAILILQAVLVMGILSHVNADFFPKCCNNCRSFSGVTSATTPIPSAPGLLGVPRGDDEPRNVALRGYEIHRRRHLRWPCKSTDRFMPAGYVPPKINKA

SEQ ID NO: 4157 - protein, 62 aa, Secale cereale
QAVLVMGVLSHVNADFFPNVLQQLQVLLGRRRLRRRPSQVPRRLLGLPRGDHEPPKRGAAPI

SEQ ID NO: 4158 - protein, 89 aa, Festuca arundinacea
MKNTKLVAILVLQAILVMGILSHVNADFFPKCCNNCRSFSGVDVCDDAHPKCPKGCSQCRVVTTKPKTTYRCADMKSTVDGTCGGPCKH

SEQ ID NO: 4159 - protein, 89 aa, Lolium multiflorum
MKNTKLVAILVLQAILVMGILSHVNADFFPKCCNNCRSFSGVDVCDDAHPKCPKGCSQCRVVTTKPKMTYRCADMKSTVDGTCGGPCKH

SEQ ID NO: 4160 - protein, 66 aa, Triticum aestivum
MKSTKLAAILILQAVLVMGILSHVNADYFPKCCNSCRSFSGVDVCDDAHPQCPKGCSAWPPRGPPW

SEQ ID NO: 4161 - protein, 537 aa, Hordeum vulgare
MALATNSAAAAAAAAALSGGAAQPRRAGFLPLKRRTISAVHAADPARSGGASVPAAAKTSSPTVAPEAAAAAAKPASWSVDSWRKKKALQLPEYPNKEELDTVLKTIETFPPIVFAGEARHLEERLAEAAMGRAFVLQGGDCAESFKEFNANNIRDTFRVLLQMGAVLMFGGQVPVVKVGRMAGQFAKPRSDNFEEKDGVKLPSYRGDNVNGDAFDLKSRTPDPDRMIRAYAQSVATLNLLRAFATGGYAAMQRVIQWNLDFMDHNEQGDRYRELAHRVDEALGFMTAAGLGMDHPIMTTTDFWTSHECLLLPYEQALTREDSTSGLFYDCSAHMVWVGERTRQLDGAHVEFLRGIANPLGIKVSDKMNPAELVKLIDILNPSNKPGRITIITRMGAENMRVKLPHLIRAVRNSGQIVTWITDPMHGNTIKAPCGLKTRPFDSIMNEVRAFFDVHDQEGSHPGGIHLEMTGQNVTECIGGSRTVTFDDLGDRYHTHCDPRLNASQSLELAFIIAERLRKRRMKSGLTNNLPLPPLAF

SEQ ID NO: 4162 - protein, 537 aa, Secale cereale
MALATNSAAAAAAIAALTGGAAQPRRAGFLPLKRRTISAVHAADPARSGPSVPAAAAAKTSSPTVAPEAAAVARPASWSVDSWRKKKALQLPEYPNKEELDAVLKTIETFPPIVFAGEARHLEERLAEAAMGRAFVLQGGDCAESFKEFNANNIRDTFRVLLQMGAVLMFGGQVPVVKVGRMAGQFAKPRSDNFEEKDGVKLPSYRGDNVNGDAFDLKSRTPDPDRMIRAYAQSVATLNLLRAFATGGYAAMQRVIQWNLDFMDHNEQGDRYRELAHRVDEALGFMTAAGLGMDHPIMTTTDFWTSHECLLLPYEQALTREDSTSGLFYDCSAHMVWVGERTRQLDGAHVEFLRGIANPLGIKVSDKMNPAELVKLIDILNPSNKPGRITIITRMGAENMRVKLPHLIRAVRNSGQIVTWITDPMHGNTIKAPCGLKTRPFDSIMNEVRAFFDVHDQEGSHPGGIHLEMTGQNVTECIGGSRTVTFDDLGDRYHTHCDPRLNASQSLELAFIIAERLRKRRMKSGLANNLPLPPLAF

SEQ ID NO: 4163 - protein, 534 aa, Triticum aestivum
MALATNTAAAAAALTGSAAQPRRAGFLPLKRRTISAVHAADPARSGASVPAAAAAKTSSPTVAPEAAAVTRPASWSVDSWRKKKALQLPEYPNKEELDAVLKTIETFPPIVFAGEARHLEDRLAEAAMGRAFVLQGGDCAESFKEFNANNIRDTFRVLLQMGAVLMFGGQVPVVKVGRMAGQFAKPRSDNFEEKDGVKLPSYRGDNVNGDAFDLKSRTPDPDRMIRAYAQSVATLNLLRAFATGGYAAMQRVIQWNLDFMDHNEQGDRYRELAHRVDEALGFMTAAGLGMDHPIMTTTDFWTSHECLLLPYEQALTREDSTSGLFYDCSAHMVWVGERTRQLDGAHVEFLRGIANPLGIKVSDKMNPAELVKLIDILNPSNKPGRITIITRMGAENMRVKLPHLIRAVRNSGQIVTWITDPMHGNTIKAPCGLKTRPFDSIMNEVRAFFDVHDQEGSHPGGIHLEMTGQNVTECIGGSRTVTFDDLGDRYHTHCDPRLNASQSLELAFIIAERLRKRRMKSGLTNNLPLPPLAF

SEQ ID NO: 4164 - protein, 521 aa, Hordeum vulgare
LSGGAAQPRRAGFLPLKRRTISAVHAADPARSGGASVPAAAKTSSPTVAPEAAAAAAKPASWSVDSWRKKKALQLPEYPNKEELDTVLKTIETFPPIVFAGEARHLEERLAEAAMGRAFVLQGGDCAESFKEFNANNIRDTFRVLLQMGAVLMFGGQVPVVKVGRMAGQFAKPRSDNFEEKDGVKLPSYRGDNVNGDAFDLKSRTPDPDRMIRAYAQSVATLNLLRAFATGGYAAMQRVIQWNLDFMDHNEQGDRYRELAHRVDEALGFMTAAGLGMDHPIMTTTDFWTSHECLLLPYEQALTREDSTSGLFYDCSAHMVWVGERTRQLDGAHVEFLRGIANPLGIKVSDKMNPAELVKLIDILNPSNKPGRITIITRMGAENMRVKLPHLIRAVRNSGQIVTWITDPMHGNTIKAPCGLKTRPFDSIMNEVRAFFDVHDQEGSHPGGIHLEMTGQNVTECIGGSRTVTFDDLGDRYHTHCDPRLNASQSLELAFIIAERLRKRRMKSGLTNNLPLPPLAF

SEQ ID NO: 4165 - protein, 525 aa, Triticum aestivum
AAAALTGSAAQPRRAGFLPLKRRTISAVHAADPARSGASVPAAAAAKTSSPTVAPEAAAVTRPASWSVDSWRKKKALQLPEYPNKEELDAVLKTIETFPPIVFAGEARHLEDRLAEAAMGRAFVLQGGDCAESFKEFNANNIRDTFRVLLQMGAVLMFGGQVPVVKVGRMAGQFAKPRSDNFEEKDGVKLPSYRGDNVNGDAFDLKSRTPDPDRMIRAYAQSVATLNLLRAFATGGYAAMQRVIQWNLDFMDHNEQGDRYRELAHRVDEALGFMTAAGLGMDHPIMTTTDFWTSHECLLLPYEQALTREDSTSGLFYDCSAHMVWVGERTRQLDGAHVEFLRGIANPLGIKVSDKMNPAELVKLIDILNPSNKPGRITIITRMGAENMRVKLPHLIRAVRNSGQIVTWITDPMHGNTIKAPCGLKTRPFDSIMNEVRAFFDVHDQEGSHPGGIHLEMTGQNVTECIGGSRTVTFDDLGDRYHTHCDPRLNASQSLELAFIIAERLRKRRMKSGLTNNLPLPPLAF

SEQ ID NO: 4166 - protein, 493 aa, Avena sativa
ADPARNSGSVPAAAKTSSPTVAPEKSVAAAPAAWAVDSWKSKKALQLPEYPNKEELDTVLQTIETFPPIVFAGEARHLEDRLAEAAMGRAFVLQGGDCAESFKEFNANNIRDTFRVLLQMGAVLMFGGQVPVVKVGRMAGQFAKPRSGNFEEKDGVKLPSYRGDNINGDAFDMKSRTPDPDRMIRAYAQSVATLNLLRAFATGGYAAMQRVIQWNLDFMDHNEQGDRYRELAHRVDEALGFMTAAGLGIDHPIMTTTDFWTSHECLLLPYEQALTREDSTSGLFYDCSAHMVWVGERTRQLDGAHVEFLRGIANPLGIKVSDKMDPAELVKLIDILNPSNKPGRITIITRMGAENMRVKLPHLIRAVRNSGQIVTWITDPMHGNTIKAPCGLKTRPFDSIMNEVRAFFDVHDQEGSHPGGIHLEMTGQNVTECIGGSRTVTFDDLGDRYHTHCDPRLNASQSLELAFIIAERLRKRRMQSGLTNNLPLPPLAF

SEQ ID NO: 4167 - protein, 537 aa, Oryza sativa
MALATNSAAVSGGAAAAASSAPQPRLAATFLPMRRRTVSAVHAADPAKSNGPVQAAAKASSPSTVAAPEKKPVGLGKWTVDSWKAKKALQLPEYPSQEELDSVLKTIETFPPVVFAGEARHLEERLADAAMGRAFVLQGGDCAESFKEFNANNIRDTFRILLQMGAVLMFGGQMPVVKVGRMAGQFAKPRSDSFEERDGVKLPSYRGDNINGDTFDEKSRVPDPQRMIRAYAQSVATLNLLRAFATGGYAAMQRVTQWNLDFMDHSEQGDRYRELAHRVDEALGFMTAAGLTVDHPIMTTTDFWTSHECLLLPYEQSLTREDSTSGLFYDCSAHMLWVGERTRQLDGAHVEFLRGVANPLGIKVSDKMNPRDLVKLIEILNPSNKPGRITIITRMGAENMRVKLPHLIRAVRNSGQIVTWITDPMHGNTIKAPCGLKTRPFDSILAEVRAFFDVHDQEGSHPGGIHLEMTGQNVTECIGGSRTVTFDDLSDRYHTHCDPRLNASQSLELAFIIAERLRRRRMRSGVNSNLPLPPLAF

SEQ ID NO: 4168 - protein, 540 aa, Setaria italica
MALATNSAATAAAAAAVSGGAASQPRRAAAFVPLKRRTISAIHAADPSKNNGSAVPAAAASSKASSFAVATPEKKPAAQGKWTVDSWKSKKALQLPEYPSQEELDSVLKTIETFPPVVFAGEARHLEERLAEAAMGRAFVLQGGDCAESFKEFHANNIRDTFRILLQMGAVLMFGGQVPVVKVGRMAGQFAKPRSEAFEERDGVKLPSYRGDNVNGDDFTEKSRVPDPQRMIRAYAQSVATLNLLRAFATGGYAAMQRVTQWNLDFMDHSEQGDRYRELAHRVDEALGFMTAAGLTVDHPIMTTTDFWTSHECLLLPYEQALTREDSTSGLFYDCSAHMLWVGERTRQLDGAHVEFLRGVANPLGIKVSDKMNPSDLVKLIEILNPSNKPGRITIITRMGAENMRVKLPHLIRAVRNAGLIVTWITDPMHGNTIKAPCGLKTRPFDSILAEVRAFFDVHDQEGSHPGGIHLEMTGQNVTECIGGSRTVTFDDLSDRYHTHCDPRLNASQSLELAFIIAERLRKRRMRSGLNNSLPLPLAF

SEQ ID NO: 4169 - protein, 540 aa, Sorghum bicolor
MALATNSAAAAAAAAAVSGGASSQPRRAAVFLPLKRRTISAIHAADPSKNNGPAVPAAAAAKSSASAVATPEKKPAAPGKWAVDSWKSKKALQLPEYPNQEELDTVLKTIETFPPVVFAGEARHLEERMAEAAMGRAFVLQGGDCAESFKEFHANNIRDTFRILLQMGAVLMFGGQVPVVKVGRMAGQFAKPRSEPFEERDGVKLPSYRGDNVNGDDFTEKSRVPDPQRMIRAYAQSVATLNLLRAFATGGYAAMQRVTQWNLDFMDHSEQGDRYRELAHRVDEALGFMTAAGLTVDHPIMTTTDFWTSHECLLLPYEQALTREDSTSGLFYDCSAHMLWVGERTRQLDGAHVEFLRGVANPLGIKVSDKMNPSDLVKLIEILNPSNKPGRITIITRMGAENMRVKLPHLIRAVRNAGLIVTWITDPMHGNTIKAPCGLKTRPFDSILAEVRAFFDVHDQEGSHPGGIHLEMTGQNVTECIGGSRTVTFDDLSDRYHTHCDPRLNASQSLELAFIIAERLRKRRMRSGLNNSLPLPPLAF

SEQ ID NO: 4170 - protein, 538 aa, Zea mays
MALATNSAAAAAAAVSGGAASQPHRAATFLPLKRRTISAIHAADPSKNNGPAVPAAAAAKSSASAVATPEKNPAAPVKWAVDSWKSKKALQLPEYPNQEELDTVLKTIETFPPVVFAGEARHLEERMAEAAMGRAFILQGGDCAESFKEFHANNIRDTFRILLQMGAVLMFGGQVPVVKVGRMAGQFAKPRSEPLEERDGVKLPSYRGDNVNGDDFTEKSRVPDPQRMIRAYSQSVATLNLLRALATGGYAAMQRVTQWNLDFMDHSEQGDRYRELAHRVDEALGFMTAAGLTVDHPIMTTTDFWTSHECLLLPYEQSLTRKDSTSGLFYDCSAHMLWVGERTRQLDGAHVEFLRGVANPLGIKVSDKMNPSDLVKLIEILNPSNKPGRITIITRMGAENMRVKLPHLIRAVRNAGLIVTWITDPMHGNTIKAPCGLKTRPFDSILAEVRAFFDVHDQEGSHPGGIHLEMTGQNVTECIGGSRTVTFDDLSDRYHTHCDPRLNASQSLELAFIIAERLRKRRMRSGLNNSLPLPPLAF

SEQ ID NO: 4171 - protein, 537 aa, Zea mays
MALATNSAAAAAAVSGGVASQPRRAAVFLPLKRRTISAIHAADPSKNNGPAVPAAAGANSSASAVATPEKKPAAHGKWAVYSWRSKKALQLPEYPNAEELDAVLKTIETFPPVVFAGEARRLEERMAEAAMGRAFVLQGGDCAESFKEFHANNIRDTFRVLLQMGVVLMFGGQMPVVKVGRMAGQFAKPRSEPFEEKDGVKLPSYRGDNVNGDDFTEKSRVPDPQRMIRAYAQSVATLNLLRAFATGGYAAMQRVTQWNLDFMDHNEQGDRYRELAHRVDDALGFMTASGLTVDHPIMTTTDFWTSHECLLLPYEQALTREDSTSGLFYDCSAHMLWVGERTRQLDGAHVEFLRGVANPLGIKVSDKMNPSELVKLIDILNPSNKPGRITIITRMGAENMRVKLPHLIRAVRNAGLIVTWITDPMHGNTIKAPCGLKTRPFDSILAEVRAFFDVHDQEGSHPGGVHLEMTGQNVTECIGGSRTVTFDDLSDRYHTHCDPRLNASQSLELAFIIAERLRKRRMRSGLNSSLPLPPLAF

SEQ ID NO: 4172 - protein, 469 aa, Secale cereale
AAAAARPASWSVDSWRKKKALQLPEYPNKEELDAVLKTIETFPPIVFAGEARHLEERLAEAAMGRAFVLQGGDCAESFKEFNANNIRDTFRVLLQMGAVLMFGGQVPVVKVGRMAGQFAKPRSDNFEEKDGVKLPSYRGDNVNGDAFDLKSRTPDPDRMIRAYAQSVATLNLLRAFATGGYAAMQRVIQWNLDFMDHNEQGDRYRELAHRVDEALGFMTAAGLGMDHPIMTTTDFWTSHECLLLPYEQALTREDSTSGLFYDCSAHMVWVGERTRQLDGAHVEFLRGIANPLGIKVSDKMNPAELVKLIDILNPSNKPGRITIITRMGAENMRVKLPHLIRAVRNSGQIVTWITDPMHGNTIKAPCGLKTRPFDSIMNEVRAFFDVHDQEGSHPGGIHLEMTGQNVTECIGGSRTVTFDDLGDRYHTHCDPRLNASQSLELAFIIAERLRKRRMKSGLANNLPLPPLAF

SEQ ID NO: 4173 - protein, 550 aa, Setaria italica
MALATNAAAAAAAAAAISGAAASQPSRAPSFLPMRRRCAVRAVHAAEPSKSHGVPAAAKTSAPTVAPEKEAAPVAAPAPAPAPKAPAKWAVDSWRSKKALQLPEYPNAAELEAVLKTIEAFPPIVFAGEARHLEERLADAAMGRAFLLQGGDCAESFKEFNSNNIRDTFRVLLQMSAVLMFGAQMPVVKVGRMAGQFAKPRSDPFEVRDGVKLPSYRGDNINGEAFDEKSRVPDPQRMIRAYAQSAATLNLIRAFATGGYAAMQRVTQWNLDFTEHSEQGDRYRELAHRVDEALGFMSAAGLTADHTLMKTTEFWTSHECLLLPYEQALTRQDSTSGLFYDCSAHMLWVGERTRQLDGAHVEFLRGIANPLGIKVSDKMNPSDLVKLIEILNPSNKPGRITIITRMGAENMRVKLPHLIRAVRQAGLIVTWITDPMHGNTIKAPCGLKTRPFDSILAEVRAFFDVHEQEGSHPGGVHLEMTGQNVTECIGGSRTVTFDDLSDRYHTHCDPRLNASQSLELSFIIAERLRKRRIRSSSGLNNILPLPPFGF

SEQ ID NO: 4174 - protein, 543 aa, Pennisetum glaucum
MALATNAAAAAAAISGAASSQPSRAPSFLPLRRRCAVRAVHAAEPSKSHGVPAAAKTLAPTVAPEKEAPPAAAPAPKAHAKWAVDSWRSKKALQLPEYPNAAELEAVLKTIEAFPPIVFAGEARHLEERLADAAMGRAFLLQGGDCAESFKEFNSNNIRDTFRVLLQMSAVLMFGAQMPVVKVGRMAGQFAKPRSDPFEVRDGVKLPSYRGDNINGEAFDEKSRVPDPQRMIRAYAQSAATLNLIRAFATGGYAAMQRVTQWNLDFTEHSEQGDRYRELAHRVDEALGFMSAAGLTADHPLMRTTEFWTSHECLLLPYEQALTRQDSTSGLFYDCSAHMLWVGERTRQLDGAHVEFLRGIANPLGIKVSDKMNPGDLVKLIEILNPTNKPGRITIITRMGAENMRVKLPHLIRAVRQAGLIVTWITDPMHGNTIKAPCGLKTRPFDSILAEVRAFFDVHEQEGSHPGGVHLEMTGQNVTECIGGSRTVTFDDLSDRYHTHCDPRLNASQSLELSFIIAERLRKRRIRSSSGLNNILPLPSFGF

SEQ ID NO: 4175 - protein, 546 aa, Saccharum officinarum
MALANTAAAAAAISGGSASASQPRRAPPSLLPLRRRCAVRAVHAAEPSKNPGVVVPAAAKTSSPTTVAPENDAAPARAPKAAAKWAVDSWRTKKALQLPEYPNPSELEAVLKTIEAFPPIVFAGEARHLEERLADAAMGRAFLLQGGDCAESFKEFNSNNIRDTFRVLLQMSAVLMFGAQMPVFKVGRMAGQFAKPRSEAFEVRDGVKLASYRGDNINGEAFDEKSRVPDPQRMIRAYAQSAATLNLLRAFATGGYAAMQRVTQWNLDFTEHSEQGDRYRELAHRVDEALGFMSAAGLTPDHPLTTTTEFWTSHECLLLPYEQALTRQDSTSGLFYDCSAHMLWVGERTRQLDGAHVEFLRGIANPLGIKVSDKMNPSDLVKLIDILNPTNKPGRITVITRMGAENMRVKLPHLIRAVRQAGQIVTWITDPMHGNTIKAPCGLKTRPFDNILAEVRAFFDVHEQEGSHPGGVHLEMTGQNVTECIGGSRTVTFDDLSDRYHTHCDPRLNASQSLELAFIIAERLRKRRIRSSSGLNNILPLPPFGF

SEQ ID NO: 4176 - protein, 551 aa, Sorghum bicolor
MALSTNAAAAAAAISGGSASASQPARRTPSSLLPLTRRRRAVVRAVHAAEPSKNPGVVVPAAAKASSPTTVAPENDAAPAPAPARAPAKWAVDSWRTKKALQLPEYPNPAELEAVLKTIEAFPPIVFAGEARHLEERLADAAMGRAFLLQGGDCAESFKEFNSNNIRDTFRVLLQMSAVLMFGAQMPVVKVGRMAGQFAKPRSDPFEVRDGVKLPSYRGDNINGEAFDEKSRVPDPQRMIRAYAQSAATLNLLRAFATGGYAAMQRVTQWNLDFTEHSEQGDRYRELAHRVDEALGFMSAAGLTPDHPLTTTTEFWTSHECLLLPYEQALTRQDSTSGLFYDCSAHMLWVGERTRQLDGAHVEFLRGIANPLGIKVSDKMNPSDLVKLIDILNPTNKPGRITVITRMGAENMRVKLPHLIRAVRQAGQIVTWITDPMHGNTIKAPCGLKTRPFDNILAEVRAFFDVHEQEGSHPGGVHLEMTGQNVTECIGGSRTVTFDDLSDRYHTHCDPRLNASQSLELAFIIAERLRKRRIRSSSGLNNILPLPPFGF

SEQ ID NO: 4177 - protein, 487 aa, Setaria italica
AVPAAAASSKASSFAVATPEKKPAAQGKWTVDSWKSKKALQLPEYPSQEELDSVLKTIETFPPVVFAGEARHLEERLAEAAMGRAFVLQGGDCAESFKEFHANNIRDTFRILLQMGAVLMFGGQVPVVKVGRMAGQFAKPRSEAFEERDGVKLPSYRGDNVNGDDFTEKSRVPDPQRMIRAYAQSVATLNLLRAFATGGYAAMQRVTQWNLDFMDHSEQGDRYRELAHRVDEALGFMTAAGLTVDHPIMTTTDFWTSHECLLLPYEQALTREDSTSGLFYDCSAHMLWVGERTRQLDGAHVEFLRGVANPLGIKVSDKMNPSDLVKLIEILNPSNKPGRITIITRMGAENMRVKLPHLIRAVRNAGLIVTWITDPMHGNTIKAPCGLKTRPFDSILAEVRAFFDVHDQEGSHPGGIHLEMTGQNVTECIGGSRTVTFDDLSDRYHTHCDPRLNASQSLELAFIIAERLRKRRMRSGLNNSLPLPLAF

SEQ ID NO: 4178 - protein, 480 aa, Panicum virgatum
ASKASTSAVATPEKPAPQGKWAIDSWKSKKALQLPEYPNQEELDTVLKTIETFPPVVFAGEARHLEERLAEAAMGRAFVLQGGDCAESFKEFHANNIRDTFRILLQMGAVLMFGGQVPVVKVGRMAGQFAKPRSEPFEERDGVKLPSYRGDNVNGDDFTEKSRVPDPQRMIRAYAQSVATLNLLRAFATGGYAAMQRVTQWNLDFMDHSEQGDRYRELAHRVDEALGFMTAAGLTVDHPIMTTTDFWTSHECLLLPYEQALTREDSTSGLFYDCSAHMLWVGERTRQLDGAHVEFLRGVANPLGIKVSDKMNPSDLVKLIEILNPSNKPGRITIITRMGAENMRVKLPHLIRAVRNAGLIVTWITDPMHGNTIKAPCGLKTRPFDSILAEVRAFFDVHDQEGSHPGGIHLEMTGQNVTECIGGSRTVTFDDLSDRYHTHCDPRLNASQSVELAFIIAERLRKRRMRSGLNNSLPLPPLAL

SEQ ID NO: 4179 - protein, 479 aa, Saccharum officinarum
KSSASAVATPEKKPAAPGKWAVDSWKSKKALQLPEYPNQEELDTVLKTIETFPPVVFAGEARHLEERMAEAAMGRAFVLQGGDCAESFKEFHANNIRDTFRILLQMGAVLMFGGQVPVVKVGRMAGQFAKPRSEPFEERDGVKLPSYRGDNVNGDDFTEKSRVPDPQRMIRAYAQSVATLNLLRAFATGGYAAMQRVTQWNLDFMDHSEQGDRYRELAHRVDEALGFMTAAGLTVDHPIMTTTDFWTSHECLLLPYEQALTREDSTSGLFYDCSAHMLWVGERTRQLDGAHVEFLRGVANPLGIKVSDKMNPSDLVKLIEILNPSNKPGRITIITRMGAENMRVKLPHLIRAVRNAGLIVTWITDPMHGNTIKAPCGLKTRPFDSILAEVRAFFDVHDQEGSHPGGIHLEMTGQNVTECIGGSRTVTFDDLSDRYHTHCDPRLNASQSLELAFIIAERLRKRRMRSGLNNSLPLPPLAF

SEQ ID NO: 4180 - protein, 542 aa, Brachypodium distachyon
MALATNHAAAAISSGAAAPQPRRAPSFLPLKRRTICAVHAAEPSKSAAAAPAAAKTSSPSVAPEKSAIPDPKPEAPAVPAKWTVDSWRAKKALQLPEYPNAAELESALKTIEAFPPIVFAGEARHLEERLADAAMGRAFLLQGGDCAESFKEFNGNNIRDTFRVLLQMSAVLTFGGQMPVIKVGRMAGQFAKPRSDSFEVRDGVKLPSYRGDNINGDAFNEKSRIPDPQRMIRAYTQSAATLNLLRAFAMGGYAAMQRVTQWNLDFTENSEQGDRYRELAHRVDEALGFMSAAGLTLDHPVMSSTEFWTSHECLLLPYEQALTRQDSTSGLFYDCSAHMLWVGERTRQLDGAHVEFLRGVANPLGIKVSDKMNPADLVKLIDILNPTNKPGRITIITRMGAENMRVKLPHLIRAVRHAGQIVTWITDPMHGNTIKAPCGLKTRPFDSILAEVRAFFDVHEQEGSHAGGVHLEMTGQNVTECIGGSRTVTFDDLGDRYHTHCDPRLNASQSLELSFIIAEKLRKRRIRSSKLNSVLPLPTYGF

SEQ ID NO: 4181 - protein, 374 aa, Triticum aestivum
GGLWRRYAPHNMMIMVQLCYTFMYFVTEAAFNRGLNPYVYVTYRHLLVALLLWPFAYYHEKKLRPKMTWMLFLEIFVLSLLGVSLTLNMYFASLKYTSPTFVTSMVNTVASITFVIAIALRMEIVDLRSARGLAKVAGTAVSFAGVTTMTLYKGAAIASPWRAPVHIPGGGDAPHDAWLKGSLLAVASCVCWSVWYIMQATSVKRYPAELSLTAWMATVGGVQSAAFTVLLQHERQDWLIGFGLKFWCIIYSGLACSGFTVFAQLWCTEKKGPVFVTMFNPVSTIMVAILAYFIFGENLYVGSIIGGVVVILGLYMLLWGKDKDQEYNAAGAATGEEQGGSPDLDCEKQQRQGKKMVGVSLARDGSEEQTKAMR

SEQ ID NO: 4182 - protein, 377 aa, Secale cereale
MGLEGLWRRYAPHNMMIMVQLCYTLMYFVTEAAFNRGLNPYVYVTYRHLLVAVLLWPFAYYHEKKLRPKMTWMLFLEIFVLSLLGVSLTLNMYFASLKYTSPTFVTSMVNTVASITFVIAIALRMEIVDLRSTRGLAKVAGTAVSFAGVTTMTLYKGAALASPWKAPVHIPGAGGDAPHDAWLKGSLLAVASCVCWSVWYIMQATSVKRYPAELSLTAWMATVGGVQSLAFALLLQHERRDWLIGFGLNFWCIIYSGLACSGFTVFAQLWCTEKKGPVFVTMFNPVSTIMVAILAYFIFGENLYVGSIIGGVVVILGLYMLLWGKDKDQEYNAAGAAASGEEQAGEPGLDCEKQQQQQAKKTLAQDGSEQEETKTTR

SEQ ID NO: 4183 - protein, 397 aa, Pennisetum glaucum
MLAAVMDYFSSCWGPRSRAGGKGSDAAGRQEGLLWYKDAGQLATGEFSMAVVQANQLLEDQSQVESGLLSLADPGPQGTFVGVYDGHGGPETSRFINDHLFNHLRKFATEHKCISADVIRKAFQATEEGFLSLVSREWALKPQIASVGSCCLVGVICSGTLYVANLGDSRAVLGRLVKATGEVLAMQLSSEHNACYEEVRQELQSAHPDDPQIVVLKHNVWRVKGLIQISRSIGDVYLKRPEFNREPLHSKFRLRETFQKPILSSDPQITEHRIQPNDQFVIFASDGLWEHLSNQEAVDLVQNSPRNGIARKLVKVAMQEAAKKREMRYSDLKKIERGVRRHFHDDITVIVVFLDSNAMSKASWSKCPSVSFRGGGVTLPAKSLAPFSAPAQLSSTY

SEQ ID NO: 4184 - protein, 264 aa, Panicum virgatum
MLAAVMDYFSSCWGPRSRDGHRGKGSDAAGRQEGLLWYKDAGQLATGEFSMAVVQANQLLEDQSQVESGSLSLAEPGPQGTFVGVYDGHGGPETARFINDHLFNHLRKFATEHKCISVDVIRKAFQATEEGFLSLVSREWSLKPQIASVGSCCLVGVICSGTLYVANLGDSRAVLGRLVKATGEVVAMQLSSEHNACKEEVRQELRLAHPDDPQIVVLKHNVWRVKGLIQISRSIGDVYLKRPEYNKEPLHSSFGFEKPSRGQS

SEQ ID NO: 4185 - protein, 399 aa, Saccharum officinarum
MLAAVMDYFSSCWGPRSRAGHRGKGSDAAGRQDGLLWYKDAGQLVTGEFSMAVVQANQLLEDQSQVESGSLSLADPGPQGTFVGVYDGHGGPETSRFINDHLFNHLRKFATEHKCVSADVIRKAFQATEEGFVSLVSKEWSMKPQIASVGSCCLVGVICAGTLYVANLGDSRAVLGRLVKATGEVMAMQLSSEHNACREEVRQELQASHPDDPHIVVLKHNVWRVKGLIQISRSIGDVYLKKPEYNREPLHSKFRLRESFQKPILSSEPQITEHRIQPNDQFVIFASDGLWEHLSNQEAVDLVQSSPRNGIARRLVKAAMQEAAKKREMRYSDLKKIDRGVRRHFHDDTTVVVVFLDSNAMSKASWSKSPSVSIRGGGVTLPAKSLAPFSALAQLNSTY

SEQ ID NO: 4186 - protein, 399 aa, Zea mays
MLAAVMDYFSSCWGPRSGAGHRGKGSDAAGRQDGLLWYKDAGQLVTGEFSMAVVQANQLLEDQSQVESGSLSLADPGPQGTFVGVYDGHGGPETSRFINDHLFNHLRRFATEHKFMSADVIRKAFQATEEGFLSLVSKEWSLKPQIASVGSCCLVGVICAGTLYVANVGDSRAVLGRLVKATGEVVAMQLSSEHNACYEEVRQELQSSHPDDPHIVVLKHNVWRVKGLIQISRSIGDVYLKKPEYNREPLHSKFRLRETFQRPILSSEPQITEHRIQPNDQFVIFASDGLWEHLSNKEAVDLVQSSPRNGIARRLVKAAMQEAAKKREMRYSDLKKIDRGVRRHFHDDITVVVVFLDSDAMSKASWSKSPSVSLRGGGVALPAKSLAPFSAPARLNSTY

SEQ ID NO: 4187 - protein, 399 aa, Zea mays
MLAAVMDYFSSCWGPRSGDGHRGKGPDAAGRQDGLLWYKDAGQLVTGEFSMAVVQANQLLEDQSQVESGSLSLADPGPQGTFVGVYDGHGGPETSRFINDHLFNHLRRFATEHKFMSADVIRKAFQATEEGFLSLVSKEWSLKPQIASVGSCCLVGVICAGTLYVANLGDSRAVLGRLVKATGEVVAMQLSSEHNACYEEVRQELQSSHPDDPHIVVLKHNVWRVKGLIQISRSIGDVYLKKPEYNREPLHSKFRLRETFQRPILSSEPQITEHRIQPNDQFVIFASDGLWEHLSNKEAVDLVQSSPHNGIARRLVKAAMQEAAKKREMRYSDLKKIDRGVRRHFHDDITVVVVFLDLNAMSKASWSKSPSVSLRGGGVTVPAKSLAPFSAPARLNSTY

SEQ ID NO: 4188 - protein, 399 aa, Sorghum bicolor
MLAAVMDYFSSCWGPRSRAGHRGKGSDAAGRQDGLLWYKDAGQLVTGEFSMAVVQANQLLEDQSQVESGPLSLADPGPQGTFVGVHDGHGGPETARFINDHLFNHLRKFATEHKCVSADVIRKAFQATEEGWLSLVSKEWSMKPQIASVGSCCLVGVICAGTLYVANLGDSRAVLGRLVKATGEAVAMQLSSEHNACHEEVRQELQSSHPDDPHIVVLKHNVWRVKGLIQISRSIGDVYLKKPEYNREPLHSKFRLRETFQRPILSADPQITEHRIQPNDQFVIFASDGLWEHLSTQEAVDLVHSSPRNGIARRLVKAAMQEAAKKREMRYSDLKKIDRGVRRHFHDDTTVVVLFLDSNAMSKASWSKSPSVSIRGGGVTLPAKSLAPFSALAQLNSTY

SEQ ID NO: 4189 - protein, 399 aa, Zea mays
MLAAVMDYFSTCWGPRSRAGHRGKGSDAAGRQDGLLWYKDAGQLVTGGFSMAVVQANQLLEDQSQVESGSLSLADYGPQGTFVGVYDGHGGPETSRFINDHLFNHLRRFATEHKSMSADVIRKAFQETEEGFLSLVIKEWSFKPQIASVGSCCLVGVICAGTLYVANLGDSRAVLGRLVKATGEVLATQLSAEHNACYEEVRQELQSSHPDDPRIVVLKHNVWRVKGLIQISRSIGDVYLKKPEYNREPLHSKFRLRETFQKPILSSEPQITEHRIQPNDQFVIFASDGLWEHLSNQEAVDLVQSSPRNGIARRLVKAAMQEAAKKREMRYSDLKKIDRGVRRHFHDDITVVVVFLDSDAMSKASWSKSPSVSLRGGGVTLPAKSLAPFSAPAQLNGTH

SEQ ID NO: 4190 - protein, 399 aa, Oryza sativa
MLAAVMDYFRSCWGPRSPAGHRVRGSDVAGRQDGLLWYKDAGQLVTGEFSMAVVQANNLLEDQSQVESGALSMAEPGPQGTFIGVYDGHGGPETARFINDHMFHHLRRFATEHKCMSTDVIRKAFQATEEGFLSLVSKQWSLKPQIAAVGSCCLVGVICSGTLYVANLGDSRAVLGRFVKSTGEVVATQLSSEHNACYEEVRQELQASHPDDPQIVVLKHNVWRVKGLIQISRSIGDVYLKRPEYNREPLHSKFRLRETFKRPILSSEPAIAVHQIQPNDHFVIFASDGLWEHLSNQEAVDLVQNNPRNGIARRLVKVAMQEAAKKREMRYSDLKKIDRGVRRHFHDDITVIVVFLDSNAISKANWSRGPSVSLRGGGVTLPANSLAPFSTPTVLSSTY

SEQ ID NO: 4191 - protein, 115 aa, Triticum aestivum
MDYFRSCWGARSRAGRRGKKGSDAAGRQDGLLWYKDAGQAATGDFSMAVVQANNLLEDQSQVESGSLSMADPGPQGTFVGVYDGHGGPETSRFINDNMFHHLRRFAPSTSACRPM

SEQ ID NO: 4192 - protein, 395 aa, Secale cereale
MDYFRSCWGARSRAGRRGKKGSDAAGRQDGLLWYKDAGQAATGDFSMAVVQANNLLEDQSQVESGSLSMADPGPQGTFVGVYDGHGGPETSRFINDNMFHHLRRFATEHKCMSADVIRKAFQATEDGFLSVVSKEWSMKPQIAAVGSCCLVGVICSGTLYIANAGDSRAVLGRLVKATGQVVAMQLSAEHNACYEEVRQELQSSHPHDPQIVVLKHNVWRVKGLIQISRSIGDVYLKRPEYNRSPLHSKFRLRETFKKPILSSEPAIAVHQIQPSDQFVIFASDGLWEHLSNQEAVDLVQSNPRNGIARKLVKAAMQEAAKKREMRYSDLKKIERGVRRHFHDDITVVVVFLDASAGSRAGWSKSPSVSVRGGGVSVPANSLAPFSAPAMVSSTY

SEQ ID NO: 4193 - protein, 395 aa, Triticum aestivum
MDYFRSCWGARSRAGRRGKKGSDAAGRQDGLLWYKDAGQAATGDFSMAVVQANNLLEDQSQVESGSLSMADPGPQGTFVGVYDGHGGPETSRFINDNMFHHLRRFATEHKCMSADVIRKAFQATEDGFLSVVSKEWSMKPQIAAVGSCCLVGVICSGTLYIANAGDSRAVLGRLVKATGQVVAMQLSAEHNACYEEVRQELQSSHPHDPQIVVLKHNVWRVKGLIQISRSIGDVYLKRPEYNRSPLHSKFRLRETFKKPILSSEPAIAVHQIQPSDQFVIFASDGLWEHLSNQEAVDLVQSNPRNGIARKLVKAAMQEAAKKREMRYSDLKKIERGVRRHFHDDITVVVVFLDASAVSRAGWSKSPSVSVRGGGVSVPANSLAPFSAPAMVSSTY

SEQ ID NO: 4194 - protein, 395 aa, Hordeum vulgare
MDYFRSCWGARSRSGRRGKKGSDAAGRQDGLLWYKDAGQAATGEFSMAVVQANNLLEDQSQVESGSLSMADPGPQGTFVGVYDGHGGPETSRFINDNMFHHLRRFATEHKCMSADVIRKAFQATEDGFLSVVSKEWSVKPQIAAVGSCCLVGVICSGTLYIANAGDSRAVLGRLVKATGQVVAMQLSAEHNACYEEVRQELQSSHPHDPQIVVLKHNVWRVKGLIQISRSIGDVYLKRPEYNRTPLHSKFRLRETFKKPILSSEPAIAVHQIQPSDQFVIFASDGLWEHLSNQEAVDLVQTNPRNGIARKLVKAAMQEAAKKREMRYSDLKKIERGVRRHFHDDITVVVVFLDASAVSRAGWSKSPSVSVRGGGVSVPANSLAPFSAPTMVSSTY

SEQ ID NO: 4195 - protein, 395 aa, Hordeum vulgare
MDYFRSCWGARSRSGRRSKKGSDAAGRQDGLLWYKDAGQAATGEFSMAVVQANNLLEDQSQVESGSLSMADPGPQGTFVGVYDGHGGPETSRFINDNMFHHLRRFATEHKCMSADVIRKAFQATEDGFLSVVSKEWSVKPQIAAVGSCCLVGVICSGTLYIANAGDSRAVLGRLVKATGQVVAMQLSAEHNACYEEVRQELQSSHPHDPQIVVLKHNVWRVKGLIQISRSIGDVYLKRPEYNRTPLHSKFRLRETFKKPILSSEPAIAVHQIQPSDQFVIFASDGLWEHLSNQEAVDLVQTNPRNGIARKLVKAAMQEAAKKREMRYSDLKKIERGVRRHFHDDITVVVVFLDASAVSRAGWSKSPSVSVRGGGVSVPANSLAPFSAPTMVSSTY

SEQ ID NO: 4196 - protein, 395 aa, Triticum aestivum
MDYFRSCWGARSRAGRRGKKGSDAAGRQDGLLWYKDAGQAATGDFSMAVVQANNLLEDQSQVESGSLSMADPGPQGTFVGVYDGHGGPETSRFINDNMFHHLRRFATEHKCMSADVIRKAFQATEDGFLSVVSKEWSMKPQIAAVGSCCLVGVICSGTLYIANAGDSRAVLGRLVKATGQVVAMQLSAEHNACYEEVRQELQSSHPHDPQIVVLKHNVWRVKGLIQISRSIGDVYLKRPEYNRSPLHSKFRLRETFKKPILSSEPAIAVHQIQPSDQFVIFASDGLWEHLSNQEAVDLVQSNPRNGIARKLVKAAMQEAAKKREMRYSDLKKIERGVRRHFHDDITVVVVFLDASAVSRAGWSKSPPVSVRGGGVSVPANSLAPFSAPTMVSSTY

SEQ ID NO: 4197 - protein, 395 aa, Brachypodium distachyon
MDYFRSCWGARSRAGHRGKKGSDTAGRQDGLLWYKDAGQVATGEFSMAVVQANNLLEDQSQVESGPLSMAEPGPHGTFVGVYDGHGGPETSRFITDNMFHHLKRFATEHKCMSADVIRKAFQATEDGFLSVVSKEWSIKPQIAAVGSCCLVGVICSGTLYIANAGDSRAVLGRLVKATGEIVAMQLSAEHNVCYEEVRQELQSSHPDDPQIVVLKHNVWRVKGLIQISRSIGDVYLKRPEYNRTPLHSKFRLRETFKKPILRSEPAIAEHQIQPSDQFVIFASDGLWEHLSNQEAVDLVQSNPRNGIARRLVKAAMQEAAKKREMRYSDLKKIERGVRRHFHDDITVVVVFLDANAASKAGWSKSPSVSVRGGGVSVRANSLAPFLAPTMLSSTY

SEQ ID NO: 4198 - protein, 284 aa, Secale cereale
MSADVIRKAFQATEDGFLSVVSKEWSMKPQIAAVGSCCLVGVICSGTLYIANAGDSRAVLGRLVKATGQVVAMQLSAEHNACYEEVRQELQSSHPHDPQIVVLKHNVWRVKGLIQISRSIGDVYLKRPEYNRSPLHSKFRLRETFKKPILSSEPAIAVHQIQPSDQFVIFASDGLWEHLSNQEAVDLVESNPRNGIARKLVKAAMQEAAKKREMRYSDLKKIERGVRRHFHDDITVVVVFLDASAVSRAGWSKSPSVSVRGGGVSVPANSLAPFSAPAMVSSTY

SEQ ID NO: 4199 - protein, 357 aa, Zea mays
MLAAVMDYFSSCWGPRSGAGHREKGSDAAGRQDGLLWYKDVGQLVTGEFSMAVVQANQLLEDQSQVESGSLSLADTGPQGTFVGVYDGHGGPETSRFINDHLFNHLRRFATEHKFMSADVIRKAFQATEEGFLSLVSKEWSLKPQIASVGSCCLVGVICAGTLYVANLGDSRAVLGRLVKATGEVLAIQLSSEHNACYEEVRQELQSSHPDDPHIVVLKHNVWRVKGIIQISRSIGDVYLKKPEYNREPLHSKFRLRETFQRPILSSEPQITEHRIQPNDQFVIFASDGLWEHLSNKEAVDLVQSSPRNGIARRLVKAAMQEAAKKREMRYSDLKKIDRGVRRHFHDDITVVVVFMP

SEQ ID NO: 4200 - protein, 378 aa, Hordeum vulgare
GKKGSDAAGRQDGLLWYKDAGQAATGEFSMAVVQANNLLEDQSQVESGSLSMADPGPQGTFVGVYDGHGGPETSRFINDNMFHHLRRFATEHKCMSADVIRKAFQATEDGFLSVVSKEWSVKPQIAAVGSCCLVGVICSGTLYIANAGDSRAVLGRLVKATGQVVAMQLSAEHNACYEEVRQELQSSHPHDPQIVVLKHNVWRVKGLIQISRSIGDVYLKRPEYNRTPLHSKFRLRETFKKPILSSEPAIAVHQIQPSDQFVIFASDGLWEHLSNQEAVDLVQTNPRNGIARKLVKAAMQEAAKKREMRYSDLKKIERGVRRHFHDDITVVVVFLDASAVSRAGWSKSPSVSVRGGGVSVPANSLAPFSAPTMVSSTY

SEQ ID NO: 4201 - protein, 653 aa, Panicum virgatum
MKSTVFSAVVVSIGYALLGWDFAALFEANRHMEKEFELENGHSIDGITISVSAFGAIVITIFSGSLLDWLGRRAILVHSSLLLFFGGLLMLWSPNIYILLLARLFVGSASGLVFTCVPIYISETSPPNIRGLLVTMPHFMFFIGTIFSYCFILWLTLMSSPKWRIMIGAIFAPSIIYLALLVYYLPESPRWLANDGKLSEARVSLQWLRGKKHDISGEIETIVESVDFISDTATETEQGQSLAGLISSHIWPQNTLYSNLSDPLVGLLGSIHETMSEATGSRRNIFFPVFNSFSFLEHEHMNENRDDSNDQQPREVYSAGEANNGDGLRTSLLSQTASVEVNDTNTSFTSEGSSSYLRRHGTSAFTQEFMSSLHDHDIEEEDEETSGMALPHQPAYRYMENSRRHPYRYRIIRLSETADMKSKWRMLLQPGIRYALCYGMLLQALQQSAGISMLLRYTPEILKQVGVVSLFSDIGLSPHSTSILISALNALLMLPCITAAMLLMDVCGRRALILGTTPILILSLSVMSLSTLVDMGSLERAILFHLALTICFCSYVIGLGPIPNVLCSEMFPTKARATCLSFCSLSFWFGGLLSAYCFPVMLSTIGLGGACGIYALMCCIALCLIYYRIPEMTAFNLEFIAELFQNSRQSRYI

SEQ ID NO: 4202 - protein, 646 aa, Sorghum bicolor
MKSTVFSAVVVSIGYAMLGWDFAALLEANHHMKKEFELLNGPSIEGITLAASTFGAIVITIFSGALLDWLGRRAILVYSSLVLFSGGVLMLWSPNIYIVLLARLIVGSGSGLVFTCVPIYISETSPPNMRGLLGTMPQFMFFIGTIFSYCLIFWLTLMSSPNWRIMIGAIFAPSIVYFALLVYYLPESPRWLASDGKISEARVSLQRLRGKKHDVSGEIAVIVDGVDIISDSAVGTARAQSFSGTSASRTWPRSTFYWQLSDPLVDLLGSIHENMSEGGSRRNSFFPVFNSFSFPEHEHMNEHRDGNSDQQTREAYSAGEVNNGDGLRASLLSQAASVEVNDANTSFTSEGSSSYLRRHGTSVLAQEFMASIHDHDIEEEEEIHGFVLPHQSAPRDMESRGRHQVVRLSETADMKFKWRVLLQPGIRHALCYGMLIQALQQSTGISGLLRCAPEILEQVGVSLFSDIGLSPHSTSILISTLQALLILPCITAAMLLMDVCGRRVLVLATTPILILSLSVMSMSILFNMGPFDRAIVFHFALTVCFCSYVIGLGPIPNILCSEIFPTKARATCASFCSLSFWFGGLLSAYCLPVMMSTIGLGGACGIYALVCCAPLFLFYYRIPETKMLNLELIAELFKLSRQEYVQ

SEQ ID NO: 4203 - protein, 427 aa, Saccharum officinarum
IGYALLGWDFAALLEANHHMEKEFELLNGPSIEGITLAASTFGAIVITIFSGALLDWLGRRAILVYSSLVLFSGGVLMLWSPNIYIVLLARLIVGSGSGLVFTCVPIYISETSPPNMRGLLGTMPQFMFFLGTIFSYCLIFWLTLMSSPNWRIMIGAISAPSIVYFALLVYYLPESPRWLASDGKISEARVSLQWLRGKKHDVSGEIAVIVEGVDIISDSAVGTARAQSFSGTSASHTWPRSTFYWQLSDPLVDLLGSIHGNMSEGGSRRNKFFPVFNSFSFPEHEHMNELRDGNSDQQTREAYSAGEVNNGDGLRASLLSQAASVEVNDTNTSFTSEGSSSYLRRHGTSVLAQEFMASIHDYDIEEEEEIHGFVSPHQSAPRDMESTGRHPFRHQIVRLSETADMSLNGGASSTRNQACLVVWHGN

SEQ ID NO: 4204 - protein, 162 aa, Pennisetum glaucum
MEPAERIESRKALGKRPRSRVLPRTASMVTVPSAAKQGRQERGAGVTSSTSLPAGGAMMGAGGSGAAPRAYYSGGYLAGAETTAAFLKACGLCNRRLGPGHDTFIYRGEVAFCSQECREKQIEYDERMEQTCSLTSIKEAPSVSGASGSDQSGSGGETVAAA

SEQ ID NO: 4205 - protein, 163 aa, Saccharum officinarum
MEPAERIESGTALGKRPRSRVLPRTASLVTLPSAAKQGRQERVGTGVPSSSSVPAGGVGMGAGAGGGGAVPGYYYGGSFSAVETAAFLKACGLCNRRLGPGHDTFIYRGEVAFCSQECREKQIEYDERMEQTCSLTSIKEAPSVSGASSSDQSGSGGETVAAA

SEQ ID NO: 4206 - protein, 161 aa, Zea mays
MEPAERIESAGTALGKRPRSRVLPRTASMVTVPSAAKQGRQERGAGVPSSCSLPAACAGMVAVPGGYYYCGTSFAAVETAAFLKACGLCKRHLGPGHDTFIYRGEVAFCSQECREKQIEYDDLDERMEQTCSVTSMKEAPSVSGASGSDQSGSGGETVAAA

SEQ ID NO: 4207 - protein, 115 aa, Setaria italica
MRLLTGGAGAGGLPFKIRSLDAFGPTVLAEGTDATGALYWVHAWTVGPGGRVTEVREYCNTALVVTRLGGDGDAAAAAASETAKAACSQSQSKQVWQSRLPDRARRNLPGLVLAI

SEQ ID NO: 4208 - protein, 115 aa, Setaria italica
MRLLTGGAGAGGLPFKIRSLDAFGPTVLAEGTDATGALYWVHAWTVGSGGRVTEVREYCNTALVVTRLGGDGDAAAAAASETAKAACSQSQSKQVWQSRLPDRARRNLPGLVLAI

SEQ ID NO: 4209 - protein, 116 aa, Saccharum officinarum
MRLLTGAGGGLPFKIRSLDAFGPTVLAEGTDATGALYWVHAWTVGPGGRVTEVREYCNTALVVTRLGGGGGADAAAAAAEEEAKATFSRSPSKQVWQSRLLPDRARRNLPGLVLAI

SEQ ID NO: 4210 - protein, 106 aa, Setaria italica
MRLLTGGAGAGGLPFKIRSLDAFGPTVLAEGTDATGALYWVHAWTVGSGGRVTEVREYCNTALVVTRLGRRRRRARSLSRSRCGRAGCPTGLAGTSLASCLPSDLN

SEQ ID NO: 4211 - protein, 351 aa, Sorghum bicolor
MAGASFLSTAPLVARGVAACSSISTPTRRHPHIRVCCRADAEGSEAAAHEERLRFRRRDFIGTCVGSAIGLELIDGSTRFSGVATAADLIERRQRSEFQSKIKDTLYVAIKAKPELVPSLLTLALNDAMTYDKATKTGGANGSIRLETSRPENSGLSAALDLLTEAKKEIDSFSKGGPISFADLIQFAAQSALKRSFLDAAIAKCGGNEEKGRTLYSAYGSNGQWGLFDRTFGRADAQEADPEGRVPEWSKASVQEMKDRFVAVGLGPRQLAVMSAFLGPDQAATEERLIADPDCRPWVEKYQRSRETVSRTDYEVDLITTLTKLSSFGQNINYEAYTYPKQKIDLGKLKL

SEQ ID NO: 4212 - protein, 353 aa, Setaria italica
MAGAAFLSTALLGARGVAASSSSSVSSPARRHAHIQVCCKGNVEGLEAAGHDERLRFRRRDFIGSCVGTAIGLEMIEGSSKFTGEATAADLIERRQRSEFQSSIKDTLYTAIKAKPELVPSLLTLALNDAITYDKATKTGGANGSIRLEISRPENSGLSAALDLLTEAKKEIDSNSKGGPISFADLIQFAAQSALKRSFLDAAIAKCGGNEDKGRTLYSAYGSNGQWGLFDRTFGRTDAQDADPEGRVPDWSKASVQEMKDRFVAVGLGPRQLAVMSAFLGPDQAATEERLIADPDCRPWVEKYQRSRETVSRTDYEVDLITALTKLGSLGQKINYEAYTYPKQKIDLGKLKL

SEQ ID NO: 4213 - protein, 355 aa, Panicum virgatum
MAGAAFLSTAQAPALLGARGVAASPSVSTPARRHLHIQVYCKGNVEGIEAADHEEGLRFRRRDFISGCVGTAIGLEFIEGSTKFTGVATAADLIERRQRSEFQSSIKDTLYTAIKAKPELVPSLLTLALNDAITYDKATKTGGANGSIRLEISRPENSGLSAALDLLTEAKKEIDSKSKGGPISFADLIQFAAQSALKRSFLDAAIAKCGGNEEKGRTLYSAYGSNGQWGLFDKTFGRTDAQEADPEGRVPDWSKASVQEMKDRFVAVGLGPRQLAVMSAFLGPDQAATEEQLIADADCRPWVEKYQRSRETVSRTDYEVDLITTLTKLSSLGQKINYEAYTYPKPKIDLGKLKL

SEQ ID NO: 4214 - protein, 353 aa, Pennisetum glaucum
MAGASFLSTVQAPALLGARGVAASSSSPVSSPARRHAHIQVCCKGNADGAHDERLRFRRRDLIGGCVGTAIGLKMIEGSSKLTGVATAADLIERRQRSEFQSSIMDTLYTAIKAKPELVPSLLTLALNDAITYDKATKTGGANGSIRLEISRPENSGLSAALDLLTEAKKEIDSNSKGGPITFADLIQFAAQSALKRSFLDAAIAKCGGNEEKGRTLYSAYGSNGQWGLFDRTFGRTDAQEADPEGRVPDWSKASVQEMKDKFIAVGLGPRQLAVMSAFLGPDQAATEERLIADPDCRPWVEKYQRSRETVSRTDYEVDLITTLTKLSSLGQKINYEAYTYPKQKIDLGKLKL

SEQ ID NO: 4215 - protein, 237 aa, Sorghum bicolor
MAAAPTVRGYGPSSSVALPRPRSRVPASLVPVARRRAPSSVRLRAAVADAPRGGLQLQRREEDEKEGLSGTVFGRGEEDEVLEKVGEEKVEGWMRESIAEIVRHIGEAPFLVHLFSNDDGEGERVTVRREPAAPESWADVRRRWGPGGQRKPDGIILVEQVAADGGASASEAARQVWGLVVQARGMECASCYVLDTCRVRSPAGFCTHFCLARVQCFGDPVELQLRNAWLNRLAGRR

SEQ ID NO: 4216 - protein, 238 aa, Zea mays
MAAPPTVRGYGPASPSSSVALPRARSRVPASLVPVPTRRAPSVRLRAAVADVPRGGLQLQRREVEVLSGTVFGREEDEVLEKVGEEKVDGWIRESIAEIVRHIGEAPFLVHLFSSGDGDGEHVTVRRETAAPESWPDVRRRWGMGGQRRPDGVILVEQVAAVAADGGASASEAARQVWGLVVQARGMEHASCYVLDTCRVRSSAGFCTHFCLARAKCFGDPVELQLRNAWLNRLAGRR

SEQ ID NO: 4217 - protein, 885 aa, Sorghum bicolor
MRVAVVGAGVSGLAAAHELARSGGGGGATVTVYEKEDYLGGHARTVAVEDDDADGGGTVQLDLGFMVFNRVTYPNMLEWFEGLGVEMEISDMSFSVSTQLGTSASRCEWGSRNGISGLLAQKSNALSPSFWRMIREILKFKNDALKYLEDHENNPDMDRNETLGQFIQSHGYSQFFQEAYLIPICACIWSCPSQGVFGFSAFFVLSFCRNHHLLQLFGRPQWLTVKGRSHSYVHKVREELESMGCQIKTSCEIKSVSSSEGGFRVTVFDGSEETYDRVIFGVHAPDALKILGAEATHEELRILGAFQYVYSDIYLHSDKSLMPRSSSAWSSWNFLGTTSKGVCVTYWLNLLQNIESTGRPFLVTLNPPHVPDHVLLKWYTSHPVPSVAAAKASLELHHIQGNRGIWFCGAYQGYGFHEDGLKAGKAAAQNLLGKESGLLVNPKQMIPSWSETGARLLVARFLGQYVSVGNLVLLEEGGTMFSFGEVGKQCHVKSVLRVHDPMFYWKVATEADLGLADAYINGYFSFVDKREGLLNLFLILIANRDANKTSSSAASKRGWWTPLLLTAGVASAKYFLRHISRKNSVTQTRQNISQHYDLSNEFFSLFLDPSMTYSCAIFKTEDESLEAAQLRKVCLLIHKAKVERDHHVLEIGCGWGSLAIQLVKQTGCKYTGITLSVEQLKYAQRKVKEAGLEDHISFMLCDYRQIPTHRKYDRIISCEMIEGVGHEYMDDFFGCCETLLAQDGIFVLQFISIPEERYEEYRRSSDFIKEYIFPGGCIPSLARITSAMSAASRLCIEHLENIGYHYYPTLIQWRDNFMVNKDAILALGFDEKFIRIWEYYFIYCAAGFKSRTLGNYQIVFSRPGNDKLSNNGDPYASFPAANQAS

SEQ ID NO: 4218 - protein, 880 aa, Setaria italica
MRVAVVGAGVSGLAAAHELARSGAGARVTVYEKEDCLGGHARTVAVEDAAAGTVHLDLGFMVFNRVTYPNMLEWFEGLGVEMEISDMSFSVSTQLGTGGSRCEWGSRNGISGLLAQKSNAISPSFWCMIREILKFKDDALKYLEDRENNPDMDRNETLGQFIQSHGYSQFFQEAYLIPICACIWSCPSQGVLGFSAFFVLSFCRNHHLLQLFGRPQWLTVKGRSHTYVQKVREELESLGCLIKTSCEIKSVSSSDGGLRVTTVDGSEETYDRVIFGVHAPDALKLLGAEATHEELRILGAFQYVYSDIYLHCDKSMMPRSSSAWSSWNFLGTTSKGVCVTYWLNLLQNIESTDRPFLVTLNPPHVPDHVLLKWYTSHPVPSVAAAKASLELHHIQGNRGIWFCGAYQGYGFHEDGLKAGKSAAQDLLGNKKGLLENPKQMIPSWTEAGARLLVARFLGQYISVGNLVLLEEGGTMFSFGEAGKKCHAKSVLRVHDPMFYWKVATEADLGLADAYINGYFSFVDKREGLLNLFLILIANRDANKSTSSGTSKRGWWTPLLLTAGVASAKYFLRHISRKNSVTQTRQNISQHYDLSNEFFSLFLDPSMTYSCAIFKTEDESLEAAQRRKIGLLIDKAKVERDHHVLEIGCGWGSLAIQLVKQTGCKYTGITLSVEQLQYAQKKVKEAGLEDHISFMLCDYRQIPTRRKYDRIISCEMIEGVGHEYMDDFFGCCESLLAQDGLFVLQFISIPEERYEEYRRSSDFIKEYIFPGGCLPSLARITSAMSAASRLCIEHLENIGYHYYPTLIRWRDNFMANKDAISALGFDDKFIRIWEYYFIYCAAGFKSRTLGNYQIVFSRPGNDKLGDNDPYASFPAANQDSS

SEQ ID NO: 4219 - protein, 872 aa, Avena sativa
MRVAVVGAGVSGLAAAHELAKAGGGGRARVTVYEAEETLGGHARTADVDGVHLDLGFMVFNRVTYPNMLEWFEELGVEMETSDMSLSVSTQLSGGGRCEWGSRNGLSGLLAQKSNALRPGFWHMIREILKFKEDALRYLEDHESNPDLDRDETLGHFIQTHGYSQLFQESYLIPICACIWSCPSQGVLGFSAFFVLSFCRNHHLLQIFGRPQWLTVKGRSHTYVNKVREELESMGCQIKTSCQVKSVSSSEGGYRVVEVSGSEETYDKIIFGAHAPDALRMLGDEATHEELRILGAFQYVYSDIYLHCDKTLMPQNPSAWSAWNFLGTTSSGVSVTYWLNLLQNIESTGRPFLVTLNPPHVPDHILLKWNTSHPVPSVAAAKASLELQQIQGNRGIWFCGAYQGYGFHEDGLKAGKSAAQGLLGQKSSLLLNPKQMVPSWTEAGARLMVTRFLNQYVTIGNMIILEEGGTMFSFGEVDKKCLVKSVLRVHDPLFYWKVATEADLGLADAYINGYFSFVDKREGLLNLFLILIANRDAQKSSNSAASNRGWWTPMLLTAGIASAKYFLRHISRKNTVTQTRRNISQHYDLSNDFFSLFLDPSMTYSCAVFKVEDESLEVASLRKVNLLIKKAKVERNHHILEIGSGWGSLAMQVVKQTGCKYTGITLSEEQLKYAQVKVKEAGLEDRITFLLCDYRQIPTRCKYDRIISCEMIEGVGHEFMDDFFGCCESLLAKDGLFVLQFISIPEERYEEYRRSSDFIKEYIFPGGCLPSLARITSAMSSASRLCIEQVENIGYHYYPTLIRWRDNFMANKDAILALGFDDKFIRVWEYYFIYCAAGFKSRTLGTYQIVFSRPGNDKLANADNPYASFPAA

SEQ ID NO: 4220 - protein, 874 aa, Avena sativa
MRVAVVGAGVSGLAAAHELVCRAGGGGGRARVTVYEAEETLGGHARTADVDGVHLDLGFMVFNRVTYPNMLEWFEELGVEMETSDMSLSVSTQLSGGGRCEWGSRNGLSGLLAQKSNALRPGFWHMIREILKFKEDALRYLEDHESNPDLDRDETLGHFIQTHGYSQLFQESYLIPICACIWSCPSQGVLGFSAFFVLSFCRNHHLLQIFGRPQWLTVKGRSHTYVNKVREELESMGCQIKTSCQVKSVSSSEGGYRVVEVSGSEETYDKIIFGAHAPDALRMLGDEATHEELRILGAFQYVYSDIYLHCDKTLMPQNPSAWSAWNFLGTTSSGVSVTYWLNLLQNIESTGRPFLVTLNPPHVPDHILLKWNTSHPVPSVAAAKASLELQQIQGNRGIWFCGAYQGYGFHEDGLKAGKSAAQGLLGQKSSLLLNPKQMVPSWTEAGARLMVTRFLNQYVTIGNMIILEEGGTMFSFGEVDKKCLVKSVLRVHDPLFYWKVATEADLGLADAYINGYFSFVDKREGLLNLFLILIANRDAQKSSNSAASNRGWWTPMLLTAGIASAKYFLRHISRKNTVTQTRRNISQHYDLSNDFFSLFLDPSMTYSCAVFKVEDESLEVASLRKVNLLIKKAKVERNHHILEIGSGWGSLAMQVVKQTGCKYTGITLSEEQLKYAQVKVKEAGLEDRITFLLCDYRQIPTRCKYDRIISCEMIEGVGHEFMDDFFGCCESLLAKDGLFVLQFISIPEERYEEYRRSSDFIKEYIFPGGCLPSLARITSAMSSASRLCIEQVENIGYHYYPTLIRWRDNFMANKDAILALGFDDKFIRVWEYYFIYCAAGFKSRTLGTYQIVFSRPGNDKLANADNPYASFPAA

SEQ ID NO: 4221 - protein, 876 aa, Brachypodium distachyon
MEKEITRVAVVGAGVSGLAAAHELCRAGGNGVRVTVYEAEERLGGHARTADVDGVQLDLGFMVFNRVTYPNMLEWFEGLGVEMETSDMSLSVSTQLSGGGRCEWGSRNGLSGLLAQKSNALRPGFWHMIREILKFKEDVLSYLSNHENNPDLDRNETLGEFIKMHGYSQLFQEAYLIPICACIWSCPSQGVLGFSAFFVLSFCRNHHLLQIFGRPQWLTIKGRSHSYVNKVREELESMGCRIKTNCQVKSVSSFEGGHRVLEVDGSEEVYDKIIFGAHAPDALRMLRDEATHEELRILGAFQYVYSDIYLHRDKSLMPRNSSAWSAWNFLGTTSSGVSVTYWLNLLQNIESKGRPFLVTLNPPHVPDHVLLKWNTSHPVPSVAAAKASLELNQIQGKRGIWFCGAYQGYGFHEDGSKAGKSAAQGLLGKKIDLLLNPKQMVPSWTEAGARLLVTRFLNQYITIGNLTILEQGGTMFSFGEVDKKCLVKSVLRVHDPLFYWKVATEADLGLADAYVNGYFSFVDKREGLLNLFLILIANRDTQKSSSSAASKRGWWTPLLLTAGIASAKYFLRHVSRKNTVTQTRQNISQHYDLSNDFFSLFLDPSMTYSCAIFKVEDESLEVAQLRKVNLLIDKAKVERDHHVLEIGSGWGCLAMQVVKQTGCKYTGITLSEEQLKYAQMKVKEAGLEDRITFLLCDYRQIPILRKYDRIISCEMIEGVGHEFMDDFFGCCESLLAQDGLLVLQFISIPEERYEEYRRSSDFIKEYIFPGGCLPSLARITSAMSAASRLCIEQVENIGYHYYPTLVRWRDNFFANKYAISALGFDDKFIRIWEYYFMYCAAGFKSRTLGNYQIVFSRPGNDKLAYADNPYASLPAA

SEQ ID NO: 4222 - protein, 870 aa, Triticum aestivum
MRVAVVGAGVSGLAAAHELARAGGAARVTVYEAEESLGGHARTADVDGVQLDLGFMVFNRVTYPNMLEWFEELGVEMEISDMSLSVSTQLSGGGRCEWGSRNGLSGLLAQKSNALRPAFWHMIREILKFKEDALKYLEDHESNPDLNRHETLGQFIQTHGYSQLFQEAYLIPICASIWSCPSQGVLGFSAFFVLSFCRNHHLLQIFGRPQWLTVKGRSHTYVNKVREELESMGCQIKTSCQVKSVSSVEGGYKVLEVGGSEEVYDKIIFGAHAPDVLRMLGDEATHEELRILGAFQYVHSDIYLHRDDTLMPQNPSAWSAWNFLGTTSSGVSVTYWLNLLQNIESTGKPFLVTLNPPHVPDHVVLKWNTGHPVPSVAAAKASLELQQIQGNRGIWFCGAYQGYGFHEDGLKAGKSAAQSLLGQKSSLLLNPKQMVPSWTETGARLLVTRFLNQYVTIGNMTILEEGGTMFSFGEVDKKCLVKTVLRVHDPLFYWKVATEADLGMADAYINGYFSFVDKREGLLNLFLILIANRDAQKSSSSAASKRGWWTPMLLTAGIASAKYFLRHISRKNTVTQTRRNISQHYDLSNDFFSIFLDPSMTYSCAVFKVEDESLEVAQQRKVNLLIKKAKVERNHHVLEIGSGWGSLAMEVVKQTGCKYTGITLSEEQLKYAQMKVKEAGLEDRITFLLCDYRQIPSRCKYDRIISCEMIEGVGHEFMDDFFGCCESLLAPDGLFVLQFISIPEERYEEYRRSSDFIKEYIFPGGCLPSLARITSAMSTASRLCIEQVENIGYHYYPTLIRWRDNFMANKDAILALGFDDKFIRVWEYYFIYCAAGFKSRTLGTYQIVFSRPGNDKLAYADNPYASLPAA

SEQ ID NO: 4223 - protein, 870 aa, Secale cereale
RVAVVGAGVSGLAAAHELARAAGGATRVTVYEAEGSLGGHARTADVDGVHLDLGFMVFNRVTYPNMLEWFEELGVEMEISDMSLSVSTQLSSGGRCEWGSRNGLSGLLAQKSNALRPAFWHMIREILKFKEDALKYLEDHESNADLDRHETLGQFIQAHGYSQLFQEAYLIPICASIWSCPSQGVLGFSAFFVLSFCRNHHLLQIFGRPQWLTIKGRSHTYVNKVREELESMGCQIKTSCQVKSVSSFQGGYKVLEVGGSEEVYDKIIFGAHAPDVLRMLGDEATHEELRILGAFQYVHSDIYLHRDDTLMPQNQSAWSAWNFLGTTSSGISVTYWLNLLQNIESTGKPFLVTLNPPDVPDHVLLKWNTGHPVPSVAAAKASLELQQIQGNRGIWFCGAYQGYGFHEDGLKAGKSAAQSLLGQKSNLLLNPKQMVPSWTETGARLLVTRFLNQYVTIGNMTILEEGGTMFSFGEVDKKCLVKTVLRVHDPLFYWKVATEADLGMADAYINGYFTFVDKREGLLNLFLILIANRDAQKSSNTAASKRGWWTPMLLTAGIASAKYFLRHISRKNTVTQTRRNISQHYDLSNDFFSLFLDPSMTYSCAVFKVEDESLAVAQQSKVNLLIKKAKVERNHHVLEIGSGWGSLAMEVVKQTGCKYTGITLSEEQLKYAQMKVKEAGLEDRITFLLCDYRQIPSRCKYDRIISCEMIEGVGHEFMDDFFGCCESLLAPDGLFVLQFISIPEERYEEYRRSSDFIKEYIFPGGCLPSLARITSAMSAASRLCIEQVENIGYHYYPTLIRWRDNFMANKDAILALGFDDKFIRVWEYYFIYCAAGFKSRTLGTYQIVFSRPGNDKLACADNPYASLPAA

SEQ ID NO: 4224 - protein, 892 aa, Brachypodium distachyon
MEKEITRVAVVGAGVSGLAAAHELCRAGGNGVRVTVYEAEERLGGHARTADVDGVQLDLGFMVFNRLINIQLIMHETEITCQVTYPNMLEWFEGLGVEMETSDMSLSVSTQLSGGGRCEWGSRNGLSGLLAQKSNALRPGFWHMIREILKFKEDVLSYLSNHENNPDLDRNETLGEFIKMHGYSQLFQEAYLIPICACIWSCPSQGVLGFSAFFVLSFCRNHHLLQIFGRPQWLTIKGRSHSYVNKVREELESMGCRIKTNCQVKSVSSFEGGHRVLEVDGSEEVYDKIIFGAHAPDALRMLRDEATHEELRILGAFQYVYSDIYLHRDKSLMPRNSSAWSAWNFLGTTSSGVSVTYWLNLLQNIESKGRPFLVTLNPPHVPDHVLLKWNTSHPVPSVAAAKASLELNQIQGKRGIWFCGAYQGYGFHEDGSKAGKSAAQGLLGKKIDLLLNPKQMVPSWTEAGARLLVTRFLNQYITIGNLTILEQGGTMFSFGEVDKKCLVKSVLRVHDPLFYWKVATEADLGLADAYVNGYFSFVDKREGLLNLFLILIANRDTQKSSSSAASKRGWWTPLLLTAGIASAKYFLRHVSRKNTVTQTRQNISQHYDLSNDFFSLFLDPSMTYSCAIFKVEDESLEVAQLRKVNLLIDKAKVERDHHVLEIGSGWGCLAMQVVKQTGCKYTGITLSEEQLKYAQMKVKEAGLEDRITFLLCDYRQIPILRKYDRIISCEMIEGVGHEFMDDFFGCCESLLAQDGLLVLQFISIPEERYEEYRRSSDFIKEYIFPGGCLPSLARITSAMSAASRLCIEQVENIGYHYYPTLVRWRDNFFANKYAISALGFDDKFIRIWEYYFMYCAAGFKSRTLGNYQIVFSRPGNDKLAYADNPYASLPAA

SEQ ID NO: 4225 - protein, 177 aa, Unknown
  Sequence found in Organisms: Sorghum bicolor, Triticum aestivum
MPPRSDHAGGSAAAAAATHADFDSIDPLFHVLRVLPFSFLRPPRTRLRLPSNLALPSPMTVFSLILLTYFAVVSGLVYDVIVEPPGIGSAQDPGTGAVRPVVFLPGRVNGQYIIEGLSSGFMFLLGGVGIILLDLAVDRTRPRSLRVSFGSAGAVAVVIAYAMAMLFLRIKIPGYLW

SEQ ID NO: 4226 - protein, 177 aa, Saccharum officinarum
MPPRSDHAGRSAAAAAATHADFDSIDPLFHVLRVLPFSFLRPPRTRLRLPSNLALPSPMTVFSLILLTYFAVVSGLVYDVIVEPPGIGSAQDPGTGAVRPVVFLPGRVNGQYIIEGLSSGFMFLLGGVGIILLDLAVDRTRPRSLRVSFGSAGAVAVVIAYAMAMLFLRIKIPGYLW

SEQ ID NO: 4227 - protein, 177 aa, Zea mays
MAPRSDHAGGSAAAPVATQAHFDSMDPLFHVLRVLPFSFLRPPRTRLRLPSNLALPSPMTVFSLILLTYFAVVSGLVYDVIVEPPGIGSAQDPGTGAVRPVVFLPGRVNGQYIIEGLSSGFMFVLGGVGIILLDLAVDRTRPRSLRASFGSAGAVAVLIAYAMAMLFLRIKIPGYLW

SEQ ID NO: 4228 - protein, 183 aa, Setaria italica
MPPRSDHAAGSAAAAAAAAAAQTHGSDFDSIDPLFHLLRVLPFSFLRPPRTRLRLPSNLALPSPMTVFSLILLTYFAVVSGLVYDVIVEPPGIGSAQDPATGAVRPVVFLPGRVNGQYIIEGLSSGFMFLLGGIGIILLDLAADRTRPRSLRVSFGGSGAVAVVIAYAMAMLFLRIKIPGYLW

SEQ ID NO: 4229 - protein, 180 aa, Panicum virgatum
MAPRSDHAGGGAAAAVAAQTHGSDFDSIDPLFHVLRVLPFSFLRPPRTRLRLPSNLALPSPMTVFSLILLTYFAVVSGLVYDVIVEPPGIGSVQDPATGAVRPVVFLPGRVNGQYIIEGLSSGFMFLLGGVGIILLDLAVDRTRPRSLRVSFGGAGAVAVVIAYAMAMLFLRIKIPGYLW

SEQ ID NO: 4230 - protein, 185 aa, Pennisetum glaucum
MPPRSDHAGGSAAAASSSAAAATQTHGSDLNSIDPLFHILRVLPFSFLRPPRTRLRLPSNLALPSPMTVFSLILLTYFAVVSGLVYDVIVEPPGIGSAQDPATGAVRPVVFLPGRVNGQYIIEGLSSGFMFLLGGIGIILLDLAADRTRPRSLRVSFGGSGAVAIVIAYAMAMLFLRIKIPGYLW

SEQ ID NO: 4231 - protein, 178 aa, Avena sativa
MAPRSEHAAGSAAAASAAAQAEFDSMDPLFHVLRVVPFSFLQPPRTRLKLPSNLALPSPMTVYALILLTYFAVVSGLVYDVIVEPPGIGSTQDPATGAVRPVVFLPGRVNGQYIIEGLSSGFMFLLGGVGIILLDLAVDRTRPRTLRISFGGTGVAAIVIAYAMAMLFLRIKIPGYLW

SEQ ID NO: 4232 - protein, 177 aa, Oryza sativa
MAPRSDSATGGAAAAQAHGSDFDSIDPLFHVLRVLPFSFLRPPRTRLRLPSNLALPSPMTVFALILLTYFAVVSGLVYDVIVEPPGIGSVQDPATGAVRPVVFLPGRVNGQYIIEGLSSGIMFVIGGIGIILLDLAVDRNRPRSLRVSFGGSGVAAIVIAYAMAMLFLRIKIPGYLW

SEQ ID NO: 4233 - protein, 176 aa, Brachypodium distachyon
MAPRSEHAAGSAAAQVHGSEFESMDPLFHVLRVVPFSFLQPPRTRLKVPSNLALPSPMTVFSLILLTYFAVVSGLVYDVIVEPPGIGSSQDPATGAVRPVVFLPGRVNGQYIIEGLSSGFMFLLGGVGIILLDLAVDRTRPRSLRISFAGSGIAAVVIAYAMAMLFLRIKIPGYLW

SEQ ID NO: 4234 - protein, 183 aa, Secale cereale
MAPRSEHAGGSASAAAAAAAAQSHGSGFDSMDPFFHAVRVVPFAFLQPPRTRLKLPSNLALPSPMVVFSLILLTYFAVVSGLVYDVIVEPPGIGSSQDPATGAVRPVVFLPGRVNGQYIIEGLSSGFMFLLGGVGIILLDLAVDRTRPRSLRVSFGGAGVAAIVIAYAMAMLFLRIKIPGYLW

SEQ ID NO: 4235 - protein, 185 aa, Hordeum vulgare
MAPRSEHAGGSASAAAAAAAAAAQSHGSGFDSMDPFFHALRVVPFAFLQPPRTRLKLPSNLALPSPMVVFSLILLTYFAVVSGLVYDVIVEPPGIGSSQDPATGAVRPVVFLPGRVNGQYIIEGLSSGFMFLLGGVGIILLDLAVDRTRPRSLRVSFGGAGVAAIVIAYAMAMLFLRIKIPGYLW

SEQ ID NO: 4236 - protein, 185 aa, Triticum aestivum
MAPRSEHAGGSASAAAAAAAAAAQSHGSGFDSMDPFFHALRVVPFAFLQPPRTRLKLPSNLALPSPMVVFSLILLTYFAVVSGLVYDVIVEPPGIGSSQDPATGAVRPVVFLPGRVNGQYIIEGLSSGFMFLLGGVGVILLDLAVDRTRPRSLRVSFGGAGVAAIVIAYAMAMLFLRIKIPGYLW

SEQ ID NO: 4237 - protein, 185 aa, Triticum aestivum
MAPRSEHAGGSASAAAAAAAPAAQSHGSGFDSMDPFFHALRVVPFAFLQPPRTRLKLPSNLALPSPMVVFSLILLTYFAVVSGLVYDVIVEPPGIGSSQDPATGAVRPVVFLPGRVNGQYIIEGLSSGFMFLLGGVGVILLDLAVDRTRPRSLRVSFGGAGVAAIVIAYAMAMLFLRIKIPGYLW

SEQ ID NO: 4238 - protein, 392 aa, Setaria italica
MVKLLAVLALVAAAAPFLRAAGQGGDEAGPLPFAVGAAPAGCDVGRGEWVRDEAARPWYQEWECPYIQPQLTCQAHGRPDKGYQNWRWQPRGCSLPSFNATMMLEMLRGKRMLFVGDSLNRGQYVSLLCLLHRAIPDSAKSFETLDSLSIFRAKDYDATIEFYWAPMLAESNSDDAVVHRVDDRVIRGAPMDKHFRFWQGAHILVFNSYLWWTAEDKIKILRGADNDLSKDIVEMKASEAYRLVLHQVVRWLERNADPKNSRAFFVTASPTHTDSTAWGEDVEGGNCYNQTTPIGDASYWGSTSREMLRVTEEVLATSRVPVGVVNITQLSEYRRDAHTQTYKKQWMEPTPEQRADPRSYADCTHWCLPGVPDTWNELLYWKLFFPSNDQAL

SEQ ID NO: 4239 - protein, 291 aa, Setaria italica
MMLEMLRGKRMLFVGDSLNRGQYVSLLCLLHRAIPDSAKSFETLDSLSIFRAKDYDATIEFYWAPMLAESNSDDAVVHRVDDRVIRGAPMDKHFRFWQGAHILVFNSYLWWTAEDKIKILRGADNDLSKDIVEMKASEAYRLVLHQVVRWLERNADPKNSRAFFVTASPTHTDSTAWGEDVEGGNCYNQTTPIGDASYWGSTSREMLRVTEEVLATSRVPVGVVNITQLSEYRRDAHTQTYKKQWMEPTPEQRADPRSYADCTHWCLPGVPDTWNELLYWKLFFPSNDQAL

SEQ ID NO: 4240 - protein, 170 aa, Sorghum bicolor
MPRSRINGNFIDKTSSIVANILLQIIPTTSGEKRAFTYYRDGMLAQSEGNYAEALQNYYEATRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 4241 - protein, 170 aa, Brachypodium distachyon
MPRSRVNGNFIDKTSSIVANILLRIIPTTSGEKRAFTYYRDGMLAQSEGNYAEALQNYYEATRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 4242 - protein, 73 aa, Brachypodium distachyon
MPRSRVNGNFIDKTSSIVANILLRIIPTTSGEKRAFTYYRDDFLNRMNDRNGCWLNPKEIMRKLCKIIMKLRD

SEQ ID NO: 4243 - protein, 161 aa, Amborella trichopoda
MPRSRINGNFIDKTSSIVANILLRIIPTTSGEKEAFTYYRDAQSEGNYAEALQNYYEATRPEIDPYDRSYILYNIGLIHTSNGEHTKALEYYFRALERNPFLPQASNNMAVICHYAIRQGDSEIAETWSDQAAEYWKQAIALTPGNYIEAQNWLKITRRFE

SEQ ID NO: 4244 - protein, 145 aa, Sorghum bicolor
MPRSRINGNFIDKTSSIVANILLQIIPTTSGEKRAFTYYRDGMLAQSEGNYAEALQNYYEATRLEIDPYDRSYILYNIGLIHTSNGEHTKALEYYFRALERNPFLPQAFNNMAVICHYGEQAILQGDSEIAEAWFDQAAEYWKQA

SEQ ID NO: 4245 - protein, 283 aa, Sorghum bicolor
MPAPTLPTPPPSPLLPPAGEPFRVFVGYDPREHEAYEVCRRSLLRRSSIPLDVRPIRQADLRAAGLYTRARGPTESTEFSFTRFLTPYLAGYRGWALFVDCDFLYLADIAELLAAAVPPADAADRIAVACVKHEYQPAEATKMDGAIQTVYPRKNWSSMVLYNCAHPKNVAVLTPDAVSTQTGAFLHRFAWLDDDEIGEVPFAWNFLVGHNRVDPADPATRPKAIHYTSGGPWFERYRDCEFADLWLKEADELRAEKDKLKLLKDKDDAGVKQEEAAAQEKVK

SEQ ID NO: 4246 - protein, 299 aa, Saccharum officinarum
MASFFGDDGADDLPRTTSHPFDSDDFGAAAADGDGAGGYASFAEGGVEEVDEEITVESDGVPIRHVSGGYSPSPFSPELEPNGGDGPILPPPTEMREEGILLREWRRKNAIELEKKEQKEKELRAQIIAEAEEFKKAFFEKRIQNCASNMVNNREREKIFVASQEKFHANADKQYWKSISDLIPHEIATIEKRGKKDKDKKPSITVIQGPKPGKPTDLSRLRHILVKLKHAPPPHMLQPPPPAPAAKEGAKDGAKEGAKDGAKEAAAAPANGAKQPAESQENPANGPSEAEKEQPAASE

SEQ ID NO: 4247 - protein, 301 aa, Sorghum bicolor
MASFFGDDGADELPRTTSHPFDSDDFGAAAADGDGAGGYGGYASFAEGGVEDVDEEITVESDGVPIRHVSGGYSPSPFSPELEPNGGDGPILPPPTEMREEGILLREWRRKNAIELEKKEQKEKELRAQIIAEAEEFKKAFFEKRIQNCASNMVNNREREKIFVASQEKFHANADKQYWKSISDLIPHEIATIEKRGKKDKDKKPSITVIQGPKPGKPTDLSRMRHILVKLKHAPPPHMLQPPPAPAAKEGAKDGAKEGAKDGAKEGAAAPANGAKQPAESQETPANGPSEAEKEQPAASE

SEQ ID NO: 4248 - protein, 305 aa, Zea mays
MASFFADDGTDDLPRTTSHPFDSDDFGAAAADVAAADGYGGYASFAEGGVEEVDEEITVESDGVPIRHVSGGYSPSPFSPELEPNGGDGPILPPPTEMGRDEGILLREWRRKNAMELEKKEQKERELRAQIIAEAEEFKKAFFEKRIQNCASNMVNNREREKIFVASQEKFHAGADKQYWKSISDLIPHEIATIEKRGKKDKDKKPSITVVQGPKPGKPTDLSRMRHILVKLKHAPPPHMLQPPPPAPAAKEGTKDGSAKGGGKDGAKEGGAAAPANGAKQPAESQETTANGPSEAEKEQPAASE

SEQ ID NO: 4249 - protein, 306 aa, Setaria italica
MASFFADDGADELPRTASHPFDSDDFGAADPAAAGGDDAGGYGGYSSFADGGVEEVEEEITVESDGVPIRHVSGGYSPSPFSPDLDSNGGDGPILPPPTEMGREEGFLLREWRRQNAIELEKKEQREKELRAQIIAEAEEFKIAFYEKRIQNCETNKVHNREREKIFVASQEKFHASADKQYWKSISELIPHEIATIEKRGGKKDKDKKPSITVIQGPKPGKPTDLSRMRQVLVKLKHAPPPHMLQPPPAPAAKEGAKDGAKEGAKDGAKEGAAAPANGTKQPAESKETPANGPSEAEKEQPAASE

SEQ ID NO: 4250 - protein, 305 aa, Panicum virgatum
MASFFADDGADELPRTTSHPFDADDFGAADPAAAGGDDAGGYGGYASFADGGVEDVEEEITVESDGVLIRHVSGGYSPSPFSPDLEPNGGDGPILPPPTEMGREEGFLLREWRRQNAIELEKKEQMEKELRAQIIAEAEEFKIAFYEKRIQNCGTNKVHNREREKIFIASQEKFHASADKQYWKSISELIPHEIATIEKRGKKDKDKKPSITVIQGPKPGKRTDLSRMRQILVKLKHAPPPHMLQPPPAPAAKEGAKDGAKEGAKDGAKEGAAAPANGTKLPAESKETPANGPSEAEKEQPAASE

SEQ ID NO: 4251 - protein, 301 aa, Panicum virgatum
MASFFADELPRTTSHPFDADDFGAADPAAAGGDDAGGYGGYASFADGGIEEVEEEITVESDGVPIRHVSGGYSPSPFSPDLEPNAGDGPILPPPTEMGREEGFLLREWRRQNAIELEKKEQREKELRAQIIAEAEEFKIAFYEKRIQNCETNKVHNREREKIFVAGQEKFHAGADKQYWKSISDLIPHEIATIEKRGKKDKDKKPSITVIQGPKPGKPTDLSRMRQILVKLKHAPPPHMLQPPPAPAAKEGAKDGAKEGAKDGAKEGAAAPANGTKQPAESKETPANGPSEAEKEQPAASE

SEQ ID NO: 4252 - protein, 305 aa, Cenchrus ciliaris
  misc_feature (209)..(209): Xaa can be any naturally occurring amino acid
  misc_feature (239)..(239): Xaa can be any naturally occurring amino acid
  misc_feature (252)..(252): Xaa can be any naturally occurring amino acid
  misc_feature (264)..(264): Xaa can be any naturally occurring amino acid
  misc_feature (269)..(269): Xaa can be any naturally occurring amino acid
MASFFADDGADELPRTTSHPFDSDDFGAADPAAAGGDDAGGYGGYSSFADGGVEEVEEEITVESDGVPIRHVSGGYSPSPFSPDLEPNGGDGPILPPPTEMGREEGFLLREWRRQNAIELEKKEQREKELRAQIIAEAEEFKIAFYEKRIQNCETNKVHNREREKIFVASQEKFHASADKQYWKSISELIPHEIATIEKRGAKKDKDKXPSITVIQGPKPGKPTDLSRMRQVLVKLKHXPPPHMLQPPPAPXAKEGAKDGAKEXAKDGXKGAAAPANGTKQPAESKETPANGPFEAEKEQPAASE

SEQ ID NO: 4253 - protein, 340 aa, Setaria italica
SKAKRTRPDTHAHAPAPAPPVHQAGAAQNLRVSPPPWPPSSPTTAPTSSRAPPPTPSTPTTSAPPTPPRPAATTPGGTVGTPPSPTGESRREEITVESDGVPIRHVSGGYSPSPFSPDLDSNGGDGPILPPPTEMGREEGFLLREWRRQNAIELEKKEQREKELRAQIIAEAEEFKIAFYEKRIQNCETNKVHNREREKIFVASQEKFHASADKQYWKSISELIPHEIATIEKRGGKKDKDKKPSITVIQGPKPGKPTDLSRMRQVLVKLKHAPPPHMLQPPPAPAAKEGAKDGAKEGAKDGAKEGAAAPANGTKQPAESKETPANGPSEAEKEQPAASE

SEQ ID NO: 4254 - protein, 310 aa, Pennisetum glaucum
MASFFADDGADELPRTTSHPFDSDDFGAADPAAAGGGGYGGYSSFADGAVEDVEEEEDITVESDGVPIRHVPGGGYSPSPFSPDLEPNGGGGGGDGPILPPPTEMGREEGFLLREWRRQNAIELEKKEQMEKELRAQIIAEAEEFKIAFYEKRIQNCETNKVHNREREKIFVASQEKFHASADKQYWKSISELIPHEIATIEKRGAKKDKDKKPSITVVQGPKPGKPTDLSRMRQVLVKLKHAPPPHMLQPPPAPAAKDGAKDGAKEGAKDGAKEGSAAPANGTKQPAESKETPANGPSGAEKEQPAPSE

SEQ ID NO: 4255 - protein, 349 aa, Setaria italica
MAKYGEGDKRWIVEERADGTNVHNWHWAERDCLEWSRARLSALLAGLTVLDGEGGLTLRTVALDKLDGEAYVNIRKGKVIPGYELSLTLSWEAEAASESGAAKVAGAAEVPYLADENADEDPDLRVTVRGDETPLARRAKDAFLARGKPLVLEKIREFVAAMAKGGPAKDELESKKTPAKAGAAPAAKKEEPPAPAPAAKEKKAKGKDKEGFKTIEMTEKFYCRAKDIYEILMDENRWKGFTQSNARISREVGGEFSLFDGSITGINEELQEGKLIAQKWRFGSWPDDLYSSVRLVFDEPESGVTIIKLKQTDVPEEDKYGNSTVVENTERGWRELIFQRIRGVFGFGI

SEQ ID NO: 4256 - protein, 356 aa, Sorghum bicolor
MAKYGEGDKRWIVEERADGTNVHNWHWAERDCLEWSRARLSSLLAGLTVLDGEGGLTLRTVALDKLDGEAYVNIRKGKVIPGYELSLTLSWEAEAAAAASESGAVKVAGAAEVPYLADENADEDPELRVTVRGDETPLARRAKDAFLARGKPMVLEKIREFVAAMAKGGPAKDELESKKTPAKVAPAAPGAAPAKKEEVVAPAPAAEKKKAKGKDKEGFKTIEMTEKFYCRSKDIYEILMDENRWKGFTQSNARISREVGGEFSLFDGSITGINEELQEGKLIAQKWRFGSWPDGLYSSVRLTFDEPESGVTIIKLKQTDVPEEDKYGNSTVVENTERGWRELIFQRIRGVFGFGI

SEQ ID NO: 4257 - protein, 355 aa, Panicum virgatum
MAKYGEGDKRWIVEERADGTNVHNWHWAERDCLEWSRARLSSLLAGLTVLDGEGGLTLRTVALDKLDGEAYVNIRKGKVIPGYELSLTLSWEAEAASEAGAAKVAGAAEVPYLADENADEDPDLRVTVRGDETPLARRAKDAFLARGKPLVLEKIREFVAAMAKGGPAKDELESKKTPTKGAAPAAAPGAAPAAKEQVPAPAPAAKEKKAKGKDKEGFKTIEMTEKFYCRAKDIYEILMDENRWKGFTQSNARISREVGGEFSLFDGSITGVNEELQEGKLIAQKWRFGSWPDGLYSSVRLVFDEPESGVTIIKLKQTDVPEEDKYGNSTVVENTERGWRELIFQRIRGVFGFGI

SEQ ID NO: 4258 - protein, 354 aa, Pennisetum glaucum
MAKYGEGDKRWIVEERADGTNVHNWHWAERDCLEWSRARLSSLLAGLTVLDGEGGLTLRTVALEKLDGEAYVNIRKGKVIPGYELSLTLSWEAEAASESGAVKVAGAAEVPYLADENADEDPDLRITIRGDETPLARRAKDAFLARGKPLVLEKIREFVAAMAKGGPAKDELDSKKTPTKAGAAAPGAAPASKKEEAPAPAPAAKEKKAKGKDKEGFKTIEMTEKFYCRAKDIYEILMDENRWKGFTQSNARISREVGGEFSLFDGSITGINEDLQEGKLIAQKWRFGSWPDGLYSSVRLVLDEPESGVTIIKLKQTDVPEEDKYGNSTVVENTERGWRELIFQRIRGVFGFGI

SEQ ID NO: 4259 - protein, 353 aa, Zea mays
MAKYGEGDKRWIVEERADGTNVHNWHWAERDCIEWSRARLSSLLAGLTVLDGEDGLTLRTVALDNLDGEAYVNIRKGKVIPGYELSLTLSWEAEAASESGAVKVAGTAEVPYLADENADEDPDLHITVRGDETPLALRAKDAFLSRGKPMVLEKIREFVAAMAKGGPAKDELDSKKTPAKVAAAAPGAAPAKKEEVVAPAPAAGKKKAKGKDKEGFKTIKMTETFYCRSKDIYEILMDENRWKGFTQSNAKISREVGGEFSLFDGCITGVNEDLQEGKLIAQKWRFGSWPDGLYSSVRLMLDEPESGVTVIKLKQTGVPEEDKYGNSTVVENTERGWRDLIFQRIRGMFGFGI

SEQ ID NO: 4260 - protein, 356 aa, Panicum virgatum
MAKYGEGDKRWIVEERADGTNVHNWHWAERDCLEWSRARLSALLAGLTVLDGEGGLTLRTVALDKLDGEAYVNIRKGKVIPGYELSLTLSWEAEAASEAGASKVAGAAEVPYLADENADEDPDLRVTVRGDETPLARRARDAFLARGKPLVLEKIREFVAAMAKGGPAKDELESKKTSAKGAAPAAAPGAAPAAKREEVPAPAPAAKEKKAKGKDKEGFKTIEMTEKFYCRAKDIYEILMDENRWKGFTQSNARISREVGGEFSLFDGSITGVNEELQEGKLIAQKWRFGSWPDGLYSSVRLVFDEPESGVTIIKLKQTDVPEEDKYGNSTVVENTERGWRELIFQRIRGVFGFGI

SEQ ID NO: 4261 - protein, 358 aa, Avena sativa
MAKFGEGDARWIVQERPDGANVHNWHWAERDCLEWSRARLSALLAGLPVLSGEGGLTLRTTTLDKLDGEAYVNIRKGKVIPGYELSLTLSWEAEATSESGVAKVTGAAEVPYLADENADEDPELRITVRGDEDPLARRAKDAFIARGKPLVLEKIREYVATMAKGGPAKDELDSKKIPTKTAAATGGTATAPAPAVKEAAAPAPAPVSKEKKAKGKEKEGFKTIEMKEKFNCRSKDIYEILMDENRWKGFTQSNARISKEVGGQFSLFDGSITGVNEELQEGKLIVQKWRFGSWADGVYSTVRLVFDEPESGVTIIKLKQTDVPEEDRYGNSTVVENTERGWTELIFQRIRAVFGFGI

SEQ ID NO: 4262 - protein, 356 aa, Oryza sativa
MAKYGEGDARWIVQERADGTNVHNWHWAERDCLEWSRSRLTSLLAGLPVLSGEGGLALRTTALDKLDGEAYVNIRKGKVIPGYELSLTLAWEAEATTESGVVKVSGAAEVPYLADENADEDPELRVTVRGDDGPVARRAKDAFLTKGKPLVLEKIREYVAAMAKGGPAKDELDSKKTPTKAAAVEAGGAATAPAPAAEKKEEAPAVKEKKAKAKDKEGFKTIEMTEKFYCRAKDMYEILMDENRWKGFTQSNARISREVGGQFSLFDGSISGVNEELQEGKLIVQKWRFGSWPDGVHSTVRLVFDEPESGVTVISLKQTDVPEEDRYGNSTVVENTERGWRELIFQRIRGVFGFGI

SEQ ID NO: 4263 - protein, 356 aa, Brachypodium distachyon
MAKFGEGDARWIVQDRADGANVHNWHWAERDCLEWSRARLSALLAGLPVLSGEGGLTLRTTTLDKLDGEAYVNIRKGKVIPGYELSLTLSWEAEATSESGVVKVTGAAEVPYLADENADEDPELRITVRGDEGPLATRAKDAFIARGKPLVLEKIREYVAIMSKGGPAKDELDAKKTPTKAATATGVTATAPAPVAKEAPAPAPAAKEKKAKGKEKEGFKTIEMTEKLNCRAEHIYEILMDENRWKGFTQSNARISKEVGGQFSLFDGSITGVNEELQEGKLIVQKWRFGSWPDGVHSTVRLVFDEPESGVTIIKLKQTDVPEEDRYGNSTVVENTERGWRELIFQRIRAVFGFGI

SEQ ID NO: 4264 - protein, 357 aa, Hordeum vulgare
AKFGEGDARWIVQERADGANVHNWHWAERDCLEWSRARLSALLAGLPVLSGEGGLTLRTTTLDKLDGEAYVNIRKGKVIPGYELSLTLAWEADAASESGVAKVTGTAELPYLADENADEDPELRITVRGDDGPFARRAKDAFIAHGKPLVIAKIREYVAAMANGGPAKDEIDSKKLSTKAAPAAGGAAVAPAPSVNVTAAPVHAPAAKEKKANGKDKEGFKTIEMTEKFNCRSKDIYEILMDENRWKGFTQSNARISKDVGGQFSLFDGSITGVNEELQEGKLVVQKWRFGSWADGVHSTVRLVFDEPESGVTIIKLKQTDVPEEDRYGNSTVVENTERGWKELIFQRIRAVFGFGV

SEQ ID NO: 4265 - protein, 350 aa, Sorghum bicolor
MSSVSGTTNGHGKEAAFYEEQLSKIGKVRTDLGQLSGKSALYCSDASIARYLIARNWDVKKATRMLKKTLKWRSEYKPDEIRWDDISDEAVTGKTYRTDYFDKIGRSILVMRPGCQNTKNPNGQVKYLVYCMENAILNLPHGQDQMVWLIDFAGFNLGNLSIQVTKMTADVLQGHYPERLGVAILYNAPRFFEPFWKMASPLLEKKTRNKVKFVYSDRPDTMKIMEDLFNMDELECAFGGKNPATFNINDYAVRMREDDKKMPLFWSPENSALASEPYLMSSQKALESISGVKTEEAGSGKRENLETAPEKSEESDTESEKEEQTRTESSTVEQKNLPGEANAPADKSGV

SEQ ID NO: 4266 - protein, 351 aa, Setaria italica
MSSASGVTNGHGKEAALYEEQKSKIGKVKTELGQLSGKSALYCSDASIARYLIARNWDVRKATKMLKKTLKWRLEYKPDEIRWDDISDEAVTGKIYRADYFDKSGRSILVMRPGCQNTKDAKGQVKYLVYCMENAILNLPHGQDQMVWLIDFAGFNLGNLSINVTKLTADVLQGHYPERLGVAILYNAPKFFEPFWKMASPILERKTRNKVKFVYSDRPDTMKIIEDLFNMDELECAFGGKNPATFNINDYAVRMREDDKKMPSFWSPENSALASEPYLMSNQKPQESSSSGVKAEETEPEKREETDTAPEKRAESDTESEKEEETQTESSTVEQKSLPGEDTAPADKSGL

SEQ ID NO: 4267 - protein, 351 aa, Pennisetum glaucum
MSSASGATNGHGKEAALYEEQKSKIGKVRTELGQLSGKSALYCSDASIARYLIARNWDVRKATKMLKKTLKWRLEYKPDEIRWDDISDEAVTGKIYRTDYFDKSGRSILVMRPGCQNTKDAKGQVKYLVYCMENAILNLPQGQDQMVWLIDFAGFNLGNLSIHVTKLTADVLQGHYPERLGVAILYNAPKFFEPFWKMASPLLERKTRNKVQFVYSDRPDTMKIIEDLFNMDELESAFGGKNPATFNINDYAVRMREDDKKMPSFWSPENSALASEPYLMSNQKLHESSSSCVKAEETDPEKREETDTAPEKREELDTKSEKEEETQTKSSTVEQKSLPGEDTAPVEKSAQ

SEQ ID NO: 4268 - protein, 358 aa, Panicum virgatum
MSLGSGMTNGHGKEAALYEQQMSKIGKVRNELGQLSAKSALYCSDASIARYLIARNWDVKKATKMLKKTLKWRSEYKPDEIRWDDISDEAVTGKIYRTDYFDKSGRSILVMRPGCQNTKNANGQVKYLVYCMENAILNLPHGQDQMVWLIDFAGFNLGNLSIHVTKLTADVLQGHYPERLGVAILYNAPKFFEPFWKMASPLLERKTRNKVKFVYSDKPDTMKIFEDLFNMDELECAFGGKNPATFNINDYAVRMREDDKKMPSFWSPENSALASERYLMSNQKPRESSSMGVKTEETESEKREDADTTDTTPENRKESDTESEEDGPKDEETQTESTTVEQKSLPGEGTAPADKSGP

SEQ ID NO: 4269 - protein, 398 aa, Sorghum bicolor
MGSGLKYRAGLCLIVAVVLIWVLSAEVTQGIFTKYKHPFAITYLGASLMVIYLPLSFLKDFIYNSMRRHSGNTSALKIASKSSFGGSAPLKNGEFQKVLEMESQKTIVINCTDVSIPVVEETKPLIYGITEMNDGAFKDKQLSTKEIATYGLYLCPLWFVTEYLSNAALARTSVASTTVLSSTSGLFTLFIGVLLGQDSINAAKVIAVFISMAGVVMTTMGQTWASDESEVGKSGATQRTLLGDMFGLMSAIAYGLFTVLLKKFCGEEGEKVDVQKLFGYLGLFTLVALWWIVWPLTALGIEPKFSMPHSAKVDEVVVANSLIGSVLSDYFWALSVVWTTPLVATLGMSLTIPLAMVADMIIHGRHYSAVYILGSVQVFSGFVIANLADRFSRSLGLL

SEQ ID NO: 4270 - protein, 398 aa, Saccharum officinarum
MGSGLKYRAGLCLIVAVVLIWVLSAEVTQGIFTKYKHPFAITYLGASLMVIYLPLSFLKDYIYNSMRRHSGNTSALKIASKSSFGGSAPLKNGEFQKVLEMESQKTIVINCTEVSIPVVEETKPLIYGITEMNDGVLKDKQLSTKEIATYGLYLCPLWFVTEYLSNAALARTSVASTTVLSSTSGLFTLFIGVLLGQDSINAAKVIAVFISMAGIVMTTMGQTWASDESEVGKSGATQRNLLSDMVGLMSAIAYGLFTVLLKKFCGEEGEKVDVQKLFGYLGLFTLVALWWIVWPLTALGIEPKFSMPHSAKVDEVVVANSLIGSVLSDYFWALSVVWTTPLVATLGMSLTIPLAMVADMIIHGRHYSAVYILGSVQVFSGFVIANLADRFSRSLGLL

SEQ ID NO: 4271 - protein, 390 aa, Setaria italica
MGSGLKYRAGLCLIVAVVLIWVISAEVTQGIFTKYKHPFAITYLGASLMVIYLPLSFLKDFIYNSMRQHSGNTGASKITSKSSFGGSAPLKNGEFQKMLEMESQKTIVIPVVEETKPLIYGITEINDGILKEKQLSTKEIATYGLYLCPLWFVTEYLSNAALARTSVASTTVLSSTSGLFTLFIGVLLGQDSINAAKIIAVFISMAGVVMTTMGQTWASDESEVGKSGATERTLLGDMFGLMSAIAYGLFTVLLKKFCGEEGEKVDVQKLFGYLGLFSLVALWWLVWPLTALGIEPKFSMPHSAKVDEVVVANGLIGSVLSDYFWALSVVWTTPLVATLGMSLTIPLAMVADMIIHGRHYSAVYILGSVQVFSGFVIANLADRFSRSLGL

SEQ ID NO: 4272 - protein, 389 aa, Pennisetum glaucum
MGSGLKYRAGLCLIVAVVLIWVISAEVTQGIFTKYRHPFAITYLGASLMVIYLPLSFLKDFIYNSIRRHSGSTGASKITSKSSFGGSAPLKNGELKMLEMESQKTIVIPVVEETKPLIYGITEINDGALKEKQLSTKEIATYGLYLCPLWFVTEYLSNAALARTSVASTTVLSSTSGLFTLFIGVLLGQDSINAAKIIAVFISMAGVVMTTMGQTWASDESEVGKSGATERTLLGDMFGLMSAIAYGLFTVLLKKFCGEEGEKVDVQKLFGYLGLFTLVALWWLVWPLTALGIEPKFSMPHSAKVDEVVVANGLIGSVLSDYFWALSVVWTTPLVATLGMSLTIPIAMVADMIIHGRHYSAVYILGSVQVFSGFVIANLADRFSRYLGL

SEQ ID NO: 4273 - protein, 391 aa, Panicum virgatum
MGSGLKYRAGLCLIVAVVLIWVISAEVTQGIFTKYKHPFAITYLGASLMVIYLPLSFLKDFIYNSMRRHSGNTSASKVTSKSSFGGSAPLKNGEFQKMLEMESQKTIVIPVVEETKPLIYGITEINDGILKEKQLSAKEIATYGLYLCPLWFVTEYLSNAALARTSVASTTVLSSTSGLFTLFIGVLLGQDSINAAKIIAVFISMAGVVMTTMGQTWASDESEVGKSGDTQRTLLGDMFGLMSAISYGLFTVLLKKICGEEGEKVDVQKLFGYLGLFSLVALWWLVWPLTALGIEPKFSMPHSTKVDEVVVANGLIGSVLSDYFWALSVVWTTPLVATLGMSLTIPLAMVADMIIHGRHYSAVYILGSVQVFSGFVIANLADRFSRSLGLL

SEQ ID NO: 4274 - protein, 267 aa, Zea mays
MNDGVLKDKQLSTKEIATYGLYLCPLWFVTEYLSNAALARTSVASTTVLSSTSGLFTLFIGVLLGQDSISASKVIAVFISMAGVVMTTMGQTWASDESEVGKSGATQRTLLGDMFGFMSAIAYGLFTVLLKKFCGEEGEKVDVQKLFGYLGLFTLVALWWIVWPLTALGIEPKFSMPHSAKVDEVVVANSLIGSVLSDYFWALSVVWTTPLVATLGMSLTIPLAMVADMIIHGRHYSAVYILCSVQVFSGFVIASLADRLSRSLGLL

SEQ ID NO: 4275 - protein, 396 aa, Oryza sativa
MGSNLKYRAGLVLIVAVVLIWVTSAEVTQGIFTKYKQPFAITYLGASLMIIYIPLSFLKDFICNLLRRSSSSSRVSKVTNKSSFGGCAPLKNGEFQKMLEMESQKTIVINYTDVDIPVIEETKPLICGITEFDDVLKEQELSTKEIAMYGLYLCPIWFVTEYLSNAALARTSVASTTVLSSTSGLFTLFIGVLLGQDSINAAKVIAVFISMAGVVMTTMGQTWASDESEISNSGATQRTLLGDMFGLLSAMSYGLFTVLLKKFAGEEGEKVDVQKLFGYLGLFSLVLLWWLVWPLTALGIEPKFTIPHSAKVDEVVLANGLIGSVLSDYFWALSVVWTTPLVATLGMSLTIPLAMVADMIIHGRRYSAVYIFGSVQVFSGFVIANLADRFSRFLGL

SEQ ID NO: 4276 - protein, 398 aa, Triticum aestivum
MGPNLKYRAGLVLIVAVVLIWVTSAEVTQGIFANYKQPFAITYLGASLMVIYIPLAFLKDFIYRLLRRNSGSSKASKIASKSSFGGSAPLKNGEFQKMLEMEPQKTVVIKITDVDIPVLEETKPLICGIGECEGGVLKEQQLSTKEIAIYGLYLCPIWFVTEYLSNAALARTSVASTTVLSSTSGLFTLFIGVLLGQDSINAAKVIAVFVSMAGVAMTTMGQTWATDESEVSNSGATQRTLLGDMFGLMSAMSYGLFTVLLKKFAGGEGSEKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSAVYIFGSVQVFSGFVIANLADRVSRFLGL

SEQ ID NO: 4277 - protein, 398 aa, Triticum aestivum
MGPNLKYRAGLVLIVAVVLIWVTSAEVTQGIFANYKQPFAITYLGASLMVIYIPLAFLKDFIYRLLRRNSGSSKASKIASKSSFGGSAPLKNGEFQKMLEMEPQKTVVIKITDVDLPVLEETKPLICGIGECEGEVLKEQQLSTKEIAIYGLYLCPIWFVTEYLSNAALARTSVASTTVLSSTSGLFTLFIGVLLGQDSINAAKVIAVFVSMAGVAMTTMGQTWATDESEVSNSGATQRTLLGDMFGLMSAMSYGLFTVLLKKFAGGEGSEKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSAVYIFGSVQVFSGFVIANLADRVSRFLGL

SEQ ID NO: 4278 - protein, 398 aa, Triticum aestivum
MGPNLKYRAGLVLIVAVVLIWVTSAEVTQGIFANYKQPFAITYLGASLMVIYIPLAFLKDFIYRLLRRNSGSSKASKIASKSSFGGSAPLKNGEFQKMLEMEPQKTVVIKITDVDLPVLEETKPLICGIGECEGEVLKEQQLSTKEIAIYGLYLCPIWFVTEYLSNAALARTSVASTTVLSSTSGLFTLFIGVLLGQDSINAAKVIAVFVSMAGVAMTTMGQTWATDESEVSNSGATQRTLLGDMFGLMSAMSYGLFTVLLKKFAGGEGSEKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSVVYIFGSVQVFSGFVIANLADRVSRFLGL

SEQ ID NO: 4279 - protein, 398 aa, Triticum aestivum
MGPNLKYRAGLVLIVAVVLIWVTSAEVTQGIFANYKQPFAITYLGASLMVIYIPLAFLKDFIYRLLRRNSGSSKASKIASKSSFGGSAPLKNGEFHKMLEMEPQKTVVIKITDVDLPVLEETKPLICGIGECEGEVLKEQQLSTKEIAIYGLYLCPIWFVTEYLSNAALARTSVASTTVLSSTSGLFTLFIGVLLGQDSINAAKVIAVFVSMAGVAMTTMGQTWATDESEVSNSGATQRTLLGDMFGLMSAMSYGLFTVLLKKFAGGEGSEKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSAVYIFGSVQVFSGFVIANLADRVSRFLGL

SEQ ID NO: 4280 - protein, 398 aa, Hordeum vulgare
MAPNLKYRAGLVLIVAVVLIWVTSAEVTQGIFASYKQPFAITYLGASLMVIYIPLAFLKDFIYKLLRGHSGSSKASKIASKSSFGGSAPVKNGEFQKMLEMEPQKTVVIKITDVDLPVLEETKPLICGIGECEGDVLKEQQLSTKEIAIYGLYLCPIWFVTEYLSNAALARTSVASTTVLSSTSGLFTLFIGVLLGQDSINAAKVIAVFVSMAGVAMTTMGQTWATDESEVSNSGATQRTLLGDMFGLMSAMSYGLFTVLLKKFAGGEGSEKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSAVYIFGSVQVFSGFVIANLADRVSRFLGL

SEQ ID NO: 4281 - protein, 398 aa, Secale cereale
MGPNLKYRAGLVLIVAVVLIWVTSAEVTQEIFASYKQPFAITYLGASLMVIYIPLAFLKDFLYRLLRRNSGSSKASKVASKSSFGGSAPLKNGEFQKMLEMEPQKTVVIKITDVDLPVLEETKPLICGIGECEGDVLKEQQLSTKEIAIYGLYLCPIWFVTEYLSNAALARTSVASTTVLSSTSGLFTLFIGVLLGQDSINAAKVIAVFVSMAGVAMTTMGQTWATDESEVSNSGATQRTLLGDMFGLMSAMSYGLFTVLLKKFAGGEGSEKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSAVYIFGSVQVFSGFVIANLADRVSRFLGL

SEQ ID NO: 4282 - protein, 65 aa, Secale cereale
MGPNLKYRAGLVLIVAVVLIWVTSAEVTQEIFASYKQPFAITYLGASLMVIYIPLAFLKDFYTDC

SEQ ID NO: 4283 - protein, 398 aa, Secale cereale
MGPNLKYRAGLVLIVAVVLIWVTSAEVTQEIFASYKQPFAITYLGASLMVIYIPLAFLKDFLYRLLRRNSGSSKALKVASKSSFGGSAPLKNGEFQKMLEMEPQKTVVIKITDVDLPVLEETKPLICGIGECEGDALKEQQLSTKEIAIYGLYLCPIWFVTEYLSNAALARTSVASTTVLSSTSGLFTLFIGVLLGQDSINAAKVIAVFVSMAGVAMTTMGQTWATDESEVSNSGATQRTLLGDMFGLMSAMSYGLFTVLLKKFAGGEGSEKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSAVYIFGSVQVFSGFVIANLADRVSRFLGL

SEQ ID NO: 4284 - protein, 398 aa, Secale cereale
MGPNLKYRAGLVLIVAVVLIWVTSAEVTQEIFASYKQPFAITYLGASLMVIYIPLAFLKDFLYRLLRRNSGSSKASKVASKSSFGGNAPLKNGEFQKMLEMEPQKTVVIKITDVDLPALEETKPLICGIGECEGDVLKEQQLSTKEIAIYGLYLCPIWFVTEYLSNAALARTSVASTTVLSSTSGLFTLFIGVLLGQDSINAAKVIAVFVSMAGVAMTTMGQTWATDESEVSNSGATQRTLLGDMFGLMSAMSYGLFTVLLKKFAGGEESEKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSAVYIFGSVQVFSGFVIANLADRVSRFLGL

SEQ ID NO: 4285 - protein, 397 aa, Brachypodium distachyon
MGSNVKYRAGLVLIVAVVLIWVTSAEVTQGIFANYKQPFAITYLGASLMVIYIPLAFLKDFIYRLLTRHSGSSRASKVTSKSSFGGTAPLKNGEFQKMLEMESQKTVVINYTDVNLPELEETKPLICGIGECGGDVKEQELSTKQIAIYGLYLCPIWFVTEYLSNAALARTSVASTTVLSSTSGLFTLFIGVLLGQDSINVAKVIAVFVSMAGVAMTTMGQTWAADESEVSNSGATQRTLLGDMFGLLSAVSYGLFTVLLKKFAGGEGSGKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSTVYIFGSVQVFSGFVIANLADRFSRFIGL

SEQ ID NO: 4286 - protein, 387 aa, Triticum aestivum
VLIVAVVLIWVTSAEVTQGIFANYKQPFAITYLGASLMVIYIPLAFLKDFIYRLLRRNSGSSKASKIASKSSFGGSAPLKNGEFQKMLEMEPQKTVVIKITDVDLPVLEETKPLICGIGECEGDVLKEQQLSTKEIAIYGLYLCPIWFVTEYLSNAALARTSVASTTVLSSTSGLFTLFIGVLLGQDSINAAKVIAVFVSMAGVAMTTMGQTWATDESEVSNSGATQRTLLGDMFGLMSAMSYGLFTVLLKKFAGGEGSEKVDVQKLFGFLGLFSLCLLWWLVWPLTALGIEPKFTMPHSAKVDEVVLANGLIGSVLSDYFWALSVVWTNPLVATLGMSLTIPLAMVADMVIHGRHYSAVYIFGSVQVFSGFVIANLADRVSRFLGL

SEQ ID NO: 4287 - protein, 395 aa, Sorghum bicolor
MPGLTAPSDYAEEPPRHPALKINSKEPFNAEPHRSALVASYITPVDFFYKRNHGPIPKVEDLSRYTVTISGLINKSIQLSMGDIWALPKYNVTATLQCAGNRRTAMSNVRKVRGVGWDISALGTATWGGAKLSDVLELVRIPKLSSVTSLGGKHVEFVSVDKCKEEKGGPYKASIPLKQATDPDADVLLAYEMNGEVLNRDHGYPLRVVVPGVIGARSVKWLDSINIKEEECQGFFVQKDYKMFPPTVDWDNINWSTRRPQMDFPVQSAICTLEDVDVIKEGKARIAGYALSGGGRGIERVDISVDGGKTWIEARRYQKDNVAYVSDGPQSDKWAWVLFEATLDIPANAEIVAKAVDSAANVQPEKVEDIWNLRGILNTSWHRIKIQNSSGRSKL

SEQ ID NO: 4288 - protein, 397 aa, Saccharum officinarum
MPGLTAPSNYAEEPPRHPALKINSKEPFNAEPHRSALVASYITPVDFFYKRNHGPIPKVEDLSRYTVSISGLVNKSIQLSMADIRALPKYNVTATLQCAGNRRTAMSKVRKVRGVGWDISALGNATWGGAKLSDVLVLVGIPELTSVTSLGGKHVEFVSVDKCKEEKGGPYTASIPLKQATDPDADVLLAYEMNGEVLNRDHGYPLRVVVPGVIGARSVKWLDSINIKEEECQGFFMQKDYKMFPPTVDWDNINWSTRRPQMDFPVQSAICTLEDVDVIKEGKARIAGYALSGGGRGIERVDISVDGGKTWVEARRYQKDNVAYVSDGPQSDKWAWVLFEATVDIPANAEIVAKAVDSAANVQPEKVEDIWNLRGILNTSWHRIKIQNSSSVGRSKM

SEQ ID NO: 4289 - protein, 397 aa, Panicum virgatum
MPGLTAPSDYAEEPPRHPALRINSKEPFNAEPHRSALVTSYITPVDFFYKRNHGPIPKVEDLSRYSVYISGLVNKPIQLSMADIWALPKYNVTATLQCAGNRRTAMSKVRKVRGVGWDISALGNATWGGAKLSDVLELVGIPKLSSVTSLGGKHVEFVSVDKCKEEKGGPYTASIPLKQATDPDADVLLAYEMNGEVLNRDHGYPLRVVVPGVIGARSVKWLDSINIIEEECQGFFTQKDYKMFPPTVDWDNINWSTRRPQMDFPVQSAICTLEDVDVIKEGKARIAGYALSGGGRGIERVDISVDGGKTWVEARRYQKDNVPYVSDGPQSDKWAWVLFEATLDIPANAEIVAKAVDSAANVQPEKVEDIWNLRGILNTSWHRIKIQNSSCIGRSKL

SEQ ID NO: 4290 - protein, 397 aa, Setaria italica
MPGLTAPSSYAEEPPRHPALKINSKEPFNAEPHRSALVSSYITPVDFFYKRNHGPIPKVEDLSRYSVSISGLVNKPIQLSMADIWALPKYNVTATLQCAGNRRTAMSKVRKVRGVGWDISALGNATWGGAKLSDVLELVGIPKLSSVSSLGGKHVEFVSVDKCKEEKGGPYTASIPLKQATDPDADVLLAYEMNGEILNRDHGYPLRVVVPGVIGARSVKWLDSINISEEECQGFFTQKDYKMFPPTVDWDNIDWSTRRPQMDFPVQSAICTLEDVDVIKEGKARIAGYALSGGGRGIERVDISVDGGKTWVEARRYQKDNVPYVSDGPQSDKWAWVLFEATLDIPANAEIVAKAVDSAANVQPENVEDIWNLRGILNTSWHRIKIQNSSCVGRSKL

SEQ ID NO: 4291 - protein, 397 aa, Setaria italica
MPGLTAPSSYAEEPPRHPALRINSKEPFNAEPHRSALVSSYITPVDFFYKRNHGPIPKVEDLSRYSVSISGLVNKPIQLSMADIWALPKYNVTATLQCAGNRRTAMSKVRKVRGVGWDISALGNATWGGAKLSDVLELVGIPKLSSVSSLGGKHVEFVSVDKCKEEKGGPYTASIPLKQATDPDADVLLAYEMNGEILNRDHGYPLRVVVPGVIGARSVKWLDSINISEEECQGFFTQKDYKMFPPTVDWDNIDWSTRRPQMDFPVQSAICTLEDVDVIKEGKARIAGYALSGGGRGIERVDISVDGGKTWVEARRYQKDNVPYVSDGPQSDKWAWVLFEATLDIPANAEIVAKAVDSAANVQPENVEDIWNLRGILNTSWHRIKIQNSSCVGRSKL

SEQ ID NO: 4292 - protein, 397 aa, Pennisetum glaucum
MPGITAPSNYAEEPPRHPDLKINSKEPFNAEPHRSALVASYITPVDFFYKRNHGPIPKVEDLSRYSVSISGLVNKPIQLTMADIWALPKYNVTATLQCAGNRRTAMSNVRKVRGVGWGISALGNATWGGAKLSDVLELVGIPKLSSVSSFGGKHVEFVSVDKCKEEKGGPYTASIPLKQATDPDADVLLAYEMNGEILNRDHGYPLRVVVPGVIGARSVKWLDSINISEEECQGFFMQKDYKMFPPTVDWDNIDWSTRRPQMDFPVQSAICTLEDVAVIKERKARVAGYALSGGGRGIERVDISVDGGKTWVEARRYQKDNVPYVSDGPHSDKWAWVHFEATLDIPPNAEIVAKAVDSAANVQPENVEDIWNLRGILNTSWHRIKIQNSSCVGRSKL

SEQ ID NO: 4293 - protein, 397 aa, Secale cereale
MPGLTAPSDYAEEPPRHPALRINSKEPFNAEPHRSALVSSYITPVDFFYKRNHGPIPKVDDISRYSVSISGLVNKHIQLSMDDIRMLPKYNVTATLQCAGNKRTAMSKVRKVRGVGWDVSALGNATWGGAKLSDVLELVGIHKLSSVTSLGGKHVEFVSVDRCKEEKGGPYKASIPLKQATDPDADVLLTYEMNGETINRDHGYPLRVVVPGVIGARSVKWLDSINIIKEECQGFFMQKDYKMFPPTVDWDNINWSTRRPQMDFPVQSAICTLEDVDVIKEGKARIAGYAVSGGGRGIERVDISVDGGKTWVEAHRYQKSNVPYVSDGAQSDKWAWVLFEATLDIPSNAEIVAKAVDSAANIQPEKVEDIWNLRGILNTSWHRIKIQNSSCVSRSKM

SEQ ID NO: 4294 - protein, 397 aa, Triticum aestivum
MPGLTAPSDYAEEPPRHPALRINSKEPFNAEPHRSALVSSYITPVDFFYKRNHGPIPKVDDISRYSVSISGLMNKHIQLSMDDIRMLPKYNVTATLQCAGNKRTAMSKVRKVRGVGWDVSALGNATWGGAKLSDVLELVGIHKLSSVTSLGGKHVEFVSVDRCKEEKGGPYKASIPLKQATDPDADVLLAYEMNGETINRDHGYPLRVVVPGVIGARSVKWLDSINIIKEECQGFFMQKDYKMFPPTVDWDNINWSTRRPQMDFPVQSAICTLEDVDVIKEGKARIAGYAVSGGGRGIERVDISVDGGKTWVEAHRYQKSNVPYVSDGAQSDKWAWVLFEATLDIPANAEIVAKAVDSAANIQPEKVEDIWNLRGILNTSWHRIKIQNTSCVSRSKM

SEQ ID NO: 4295 - protein, 397 aa, Hordeum vulgare
MPGLTAPSDYAEEPPRHPDLRINSKEPFNAEPHRSALVSSYITPVDFFYKRNHGPIPKVDDISRYSVSISGLVNKHIQLSMDDIRMLPKYNVTATLQCAGNKRTAMSKVRKVRGVGWDISALGNATWGGAKLSDVLELVGIHKLSSVTSLGGKHVEFVSVDRCKEEKGGPYKASIPLKQATDPDADVLLAYEMNGETINRDHGYPLRVVVPGVIGARSVKWLDSIKIIKEECQGFFMQKDYKMFPPTVDWDNINWSTRRPQMDFPVQSAICTLEDVDVIKEGKARIAGYAVSGGGRGIERVDISVDGGKTWVEAHRYQKSNVPYVSDGAQSDKWAWVLFEATLDIPPNAEILAKAVDSAANIQPEKVEDIWNLRGILNTSWHRIKIQNSSCVSRSKM

SEQ ID NO: 4296 - protein, 397 aa, Pseudoroegneria spicata
MPGLTAPSDYAEEPPRHPDLRINSKEPFNAEPHRSALVSSYITPVDFFYKRNHGPIPKVDDISRYSVSISGLVNKHIQLSMDDIRMLPKYNVTATLQCAGNKRTAMSKVRKVRGVGWDVSALGNATWGGAKLSDVLELVGIHKLSSVTSLGGKHVEFVSVDRCKEEKGGPYKASIPLKQATDPDADVLLAYEMNGETINRDHGYPLRVVVPGVIGARSVKWLDSINIIKEECQGFFMQKDYKMFPPAVDWDNINWSTRRPQMDFPVQSAICTLEDVDVIKEGKARIAGYAVSGGGRGIERVDISVDGGKTWVEAHRYQKSNVPYVSDGAQSDKWAWVLFEATLDIPSNAEIVAKAVDSAANIQPEKVEDIWNLRGILNTSWHRIKIQNSSCVSRSKM

SEQ ID NO: 4297 - protein, 397 aa, Oryza sativa
MPGLTAPASYSDEPPRHPALKINSKEPFNAEPHRSALVSSYITPVDFFYKRNHGPIPIVDDLSRYSVSITGIVNKNVQLSMADIRSLPKYDVTATLQCAGNRRTAMSKVRKVRGVGWDISALGNATWGGAKLSDVLELVGIPKLSSVTSLGGKHVEFVSVDRCKEEKGGPYKASIPLKQATDPEADVLLAYEMNGETLNRDHGYPLRVVVPGVIGARSVKWLDSINIIEEECQGFFVQKDYKMFPPSVDWDNINWSTRRPQMDFPVQSAICTLEDVDVIKEGKARIAGYAVSGGGRGIERVDISVDGGKTWVEAHRYQKSNVPYISDGPRSDKWAWVLFEATLDVPANAEIVAKAVDSAANVQPEKVEDVWNLRGILNTSWHRIKIQNSSCVGRSKM

SEQ ID NO: 4298 - protein, 397 aa, Triticum aestivum
MPGLTAPSDYAEEPPRHPALRINSKEPFNAEPHRSALVSSYITPVDFFYKRNHGPIPKVDDISRYSVSISGLINKHIQLSMDDIRMLPKYNVTATLQCAGNKRTAMSKVRKVRGVGWDVSALGNATWGGAKLSDVLELVGIHKLSSVTSLGGKHVEFVSVDRCKEEKGGPYKASIPLKQATDPDADVLLAYEMNGETINRDHGYPLRVVVPGVIGARSVKWLDSINIIKEECQGFFMQKDYKMFPPTVDWDNINWSTRRPQMDFPVQSAICTLEDVDVIKEGKARIAGYAVSGGGRGIERVDISVDGGKTWVEAHRCQKSNVPYVSDGAQSDKWAWVLFEATLDIPPNAEIVAKAVDSAANIQPEKVEDIWNLRGILNTSWHRIKIQNTSCVSRSKM

SEQ ID NO: 4299 - protein, 724 aa, Sorghum bicolor
MSGGVLFLALLAAAAALAIIVAPSPANAAVSYDHRAVVINGQRRILISGSIHYPRSTPEMWPDLLQKAKDGGLDVVQTYVFWNGHEPQQGQYYFGDRYDLVRFVKLAKQAGLFVHLRIGPYVCAEWNFGGFPVWLKYVPGVSFRTDNAPFKAAMQAFVEKIVSMMKAEGLFEWQGGPIILAQVENEYGPMESVMGGGAKPYANWAAKMAVATGAGVPWVMCKQDDAPDPVINTCNGFYCDYFSPNSNSKPTMWTEAWTGWFTAFGGAVPHRPVEDMAFAVARFIQKGGSFVNYYMYHGGTNFDRTSGGPFIATSYDYDAPIDEYGLLRQPKWGHLRDLHKAIKQAEPALVSGDPTIQTIGNYEKAYVYKSSSGACAAFLSNYHTNAAARVVFNGRRYDLPAWSISVLPDCRTAVFNTATVSSPSAPARMTPAGGFSWQSYSEATNSLDDRAFTKDGLVEQLSMTWDKSDYLWYTTYVNINSNEQFLKSGQWPQLTIYSAGHALQVFVNGQSYGAAYGGYDSPKLTYSGYVKMWQGSNKISILSAAVGLPNQGTHYEAWNVGVLGPVTLSGLNEGKRDLSNQKWTYQIGLHGESLGVHSVAGSSSVEWGSAAGKQPLTWHKAYFNAPSGNAPVALDMSSMGKGQAWVNGHHIGRYWSYKATGGSCGGCSYAGTYSETKCQTGCGDVSQRYYHVPRSWLNPSGNLLVVLEEFGGDLSGVKLVTRTT

SEQ ID NO: 4300 - protein, 734 aa, Saccharum officinarum
MSGGVPLLALAALLAVAAIIIVPSPANATVSYDHRAVVINGQRRILISGSIHYPRSTPEMWPDLLQKAKDGGLDVVQTYVFWNGHEPVQGQYYFGDRYDLVRFVKLAKQAGLYVHLRIGPYVCAEWNFGGFPVWLKYVPGISFRTDNTPFKAAMQTFVEKIVSMMKSEGLFEWQGGPIILAQVENEYGPMESVMGGGAKPYASWAAKMAVATGAGVPWVMCKQDDAPDPVINTCNGFYCDYFSPNSNSKPTMWTEAWTGWFTAFGGAVPHRPVEDMAFAVARFIQKGGSFINYYMYHGGTNFDRTSGGPFIATSYDYDAPIDEYGLLRQPKWGHLRDLHKAIKQAEPALVSGDPTIQSIGNYEKAYVFKSSSGACAAFLSNYHTSAAARVVFNGRRYDLPAWSISVLPDCKTAVFNTATVREPSAPARMSPVGGFSWQSYSEATNSLDDRAFTKDGLVEQLSMTWDKSDYLWYTTYVNINSNEQFLKSGQWPQLTIYSAGHALQVFVNGQSYGAAYGGYDSPKLTYSGYVKMWQGSNKISILSAAVGLPNQGTHYEAWNVGVLGPVTLSGLNEGKRDLSNQKWTYQIGLHGESLGVHSVAGSSSVEWGGAAGKQPLTWHKAYFNAPSGNAPVALDMGSMGKGQAWVNGHHIGRYWSYKASGGSCGGCSYTGTYSETKCQTSCGDISQRYYHVPRSWLNPSGNLLVVLEEFGGRPVRGQASYQDRMIGNGDQVVN

SEQ ID NO: 4301 - protein, 228 aa, Setaria italica
MSGGALLVALLAAAAVIIVSSPAPANAAVSYDHRAVTINGQRRVLISGSIHYPRSTPEMWPDLLQKAKDGGLDVVQTYVFWNGHEPVQGQYYFGDRYDLVRFVKLAKQAGLLVHLRIGPYVCAEWNFGGFPVWLKYVPGISFRTDNGPFKAAMQAFVEKIVSMMKAEGLFEWQGGPIILAQVENEYGPMESVMGGGAQPYASWAAKMAVATGARVPWVMCKQTTPPTP

SEQ ID NO: 4302 - protein, 719 aa, Brachypodium distachyon
MSGGVLLLVLLVAAAAVFASPANAAVSYDHKAIVINGQRRILMSGSIHYPRSTPEMWPDLIQKAKDGGLDVIQTYVFWNGHEPVQGQYYFGDRYDLVRFVKLAKQAGLYVHLRIGPYVCAEWNFGGFPVWLKYVPGISFRTDNGPFKAAMQTFVEKIVSMMKSEGLFEWQGGPIILAQVENEYGPMESVMGGGAKPYANWAAKMAVATGAGVPWVMCKQDDAPDPVINTCNGFYCDYFTPNSNGKPNMWTEAWSGWFTAFGGAVPHRPVEDLAFAVARFVQKGGSFVNYYMYHGGTNFDRTAGGPFIATSYDYDAPIDEYGLLRQPKWGHLRDLHKAIKQAEPAMVSGDPTIQSIGNYEKAYVFKSSTGACAAFLSNYHTSSPAKVVYNGRRYELPAWSISILPDCKTAVYNTATVKEPSAPAKMNPAGGFSWQSYSEDTNSLDDSAFTKDGLVEQLSMTWDKSDFLWYTTYVNIDSSEQFLKSGQWPQLTINSAGHTLQVFVNGQSYGAGYGGYDSPKLSYSKYVKMWQGSNKISILSSAVGLANQGTHYENWNVGVLGPVTLSGLNQGKRDLSNQKWTYQIGLKGESLGVHSITGSSSVEWGSANGAQPLTWHKAYFSAPAGGAPVALDMGSMGKGQIWVNGRNAGRYWSYKASGSCGSCSYTGTYSETKCQTNCGDISQRWYHVPRSWLNPSGNLLVVLEEFGGDLSGVKLMTRTT

SEQ ID NO: 4303 - protein, 722 aa, Panicum virgatum
MPGGAALLLALLALAAIGPSPANAAVSYDHRAVVINGQRRVLISGSIHYPRSAPEMWPDLLQKAKDGGLDVVQTYVFWNGHEPVQGQYYFGDRYDLVRFVKLAHQAGLYVHLRIGPYVCAEWNFGGFPVWLKYVPGISFRTDNGPFKAAMQAFVEKVVSMMKAEGLFEWQGGPVILAQVENEYGPMEPSMGAGAKPYAAWAARMAVATGAGVPWVMCKQDDAPDPVINTCNGFYCDYFSPNSNSKPTMWTEAWSGWFTAFGKPVPHRPVEDLAFAVARFIQKGGSFVNYYMYHGGTNFDRTSGGPFIATSYDYDAPIDEYGLLRQPKWGHLKDLHAAIKQAEPALVAGDPTVQSLGNYEKAYVFKSSGGACAAFLSNYKTDAAATVAFNGRRYELPAWSISVLPDCKTAVFNTATVRAPSAPARMSPAAAGLAWRSYGEATNALDSRAFTKDGLVEQLGMTWDKSDYLWYTTYVNIDSNEQFLKSGKWPQLTIYSAGHALQVFVNGQSYGAAYGGYDSPKLTYSGYVKMWQGSNKISILSAAVGLPNQGTHYETWNVGVLGPVTLSGLNEGKRDLSGQKWTYQIGLHGESLGIYSAAGSSSVAWGGAAGSQPLTWHKAYFDAPAGGAPVALDLGSMGKGQAWVNGRHVGRYWSYRAAGGGCGGCGYAGTYSETKCQSGCGEVSQRYYHVPRAWLSPGGGNLLVLLEEFGGDLAGVTVVTRTT

SEQ ID NO: 4304 - protein, 696 aa, Pennisetum glaucum
AVSYDHRAVTINGQRRVLISGSIHYPRSTPEMWPDLLQKAKDGGLDVVQTYVFWNGHEPVQGQYYFGDRYDLVRFVKFAKQAGLLVHLRIGPYVCAEWNFGGFPVWLKYVPGISFRTDNGPFKAAMQTFVEKIVSMMKSEGLFEWQGGPIILAQVENEYGPMESVMGGGAKPYANWAAKMAVATGAGVPWVMCKQDDAPDPVINTCNGFYCDYFTPNSNSKPTMWTEAWSGWFTAFGKPVPHRPVEDLAFAVARFIQKGGSFVNYYMYHGGTNFDRTSGGPFIATSYDYDAPIDEYGLLRQPKWGHLRDLHKAIKQAEPALVSGDPTVQSIGNYEKAYVFKSSGGACAAFLSNYKTNAPATVVFNGRRYDLPAWSISVLPDCKTAVFNTATVKEPLVPATMSPAGGFSWRSYSEATNSLDDRAFTKDGLVEQLSMTWDKSDYLWYTTYVNIDSSEQFLKSGKWPQLTIYSAGHALQVFVNGQSYGTAYGGYDNPKLTYSGYVKMWQGSNKIAILSAAVGLPNQGTHYETWNVGVLGPVTLSGLNEGKRDLSNQKWTYQIGLHGESLGVHTAAGTSSVEWGGAAGNQPLTWHRAYFNAPAGGAPVALDLGSMGKGQAWVNGHHIGRYWSYKASGGGCGGCGYAGTYSETKCQSGCGDVSQRYYHIPRSWLNPSGNLVVLLEEFGGDLSGVKLVTRTA

SEQ ID NO: 4305 - protein, 721 aa, Secale cereale
MPSGGAGALLLLALLAAAAAAGVANAAVSYDHRAVVINGQRRILMSGSIHYPRSTPEMWPGLIQKAKDGGLDVIQTYVFWNGHEPARGQYHFADRYDLVRFVKLAGQAGLYVHLRIGPYVCAEWNFGGFPVWLKYVPGISFRTDNGPFKAEMQRFVEKIVSMMKSEGLFESQGGPIILAQVENEYGPMESAMGAGAKPYANWAAKMAVATDAGVPWVMCKQDDAPDPVINTCNGFYCDYFSPNSNSKPTMWTEAWTGWFTAFGGPVPHRPVEDMAFAVARFIQKGGSFVNYYMYHGGTNFDRTAGGPFIATSYDYDAPIDEYGLIRQPKWGHLRDLHKAIKQAEPALVSGDPTVQRIGNYEKAYVFKSSTGACAAFLSNYHTSSAARVVYNGRRYDLPAWSISILPDCKTAVFNTATVKEPSLPARMNPAGGFAWQSYSEDTNALDSSAFTKDGLVEQLSMTWDKSDYLWYTTYVNIDSSEQFLKSGQWPQLTINSAGHSVQVFVNGQSFGVAYGGYNSPKLTYSKSVKMWQGSNKISILSSAMGLPNQGTHYEAWNVGVLGPVTLSGLNQGKRDLSNQKWTYQIGLKGESLGVNSISGSSSVEWSSASGAQPLTWHKAYFAAPAGSAPVALDMGSMGKGQIWVNGNNAGRYWSYRASGSCGACSYTGTFSEAKCQTNCGDISQRWYHVPRSWLKPSGNLLVVLEEFGGDLSGVTLMTRTT

SEQ ID NO: 4306 - protein, 716 aa, Hordeum vulgare
MRSGALLLALLAAAAAAVVNAAVSYDHRAVVINGQRRILMSGSIHYPRSTPEMWPDLIQKAKDGGLDVIQTYVFWNGHEPARGQYHFADRYDLVRFVKLARQAGLYVHLRIGPYVCAEWNFGGFPVWLKYVPGISFRTDNGPFKAEMQRFVEKIVSMMKSEGLFEWQGGPIILAQVENEYGPMESAMGAGAKPYANWAANMAVATDAGVPWVMCKQDDAPDPVINTCNGFYCDYFTPNSNSKPTMWTEAWTGWFTAFGGPVPHRPVEDMAFAVARFIQKGGSFVNYYMYHGGTNFDRTAGGPFIATSYDYDAPIDEYGLIRQPKWGHLRDLHKAIKQAEPALVSGDPTIQRIGNYEKAYVFKSSTGACAAFLSNYHTSSAARIVYNGRRYDLPAWSISILPDCKTAVFNTATVKEPTAPAKMNPAGGFAWQSYSEDTNALDSTAFTKDGLVEQLSMTWDKSDYLWYTTYVNIDSSEQFLKTGQWPQLTINSAGHSVQVFVNGQSFGVAYGGYNSPKLTYSKPVKMWQGSNKISILSSAMGLPNQGTHYEAWNVGVLGPVTLSGLNQGKRDLSNQKWTYQIGLKGESLGVNSISGSSSVEWSSASGAQPLTWHKAYFAAPAGSAPVALDMGSMGKGQIWVNGNNAGRYWSYRASGSCGGCSYAGTFSEAKCQTNCGDISQRWYHVPRSWLKPSGNLLVVLEEFGGDLSGVTLMTRTT

SEQ ID NO: 4307 - protein, 720 aa, Secale cereale
MPSGGGGLLFLALLAAAAAAGVVNAAVSYDHRAVVINGQRRILMSGSIHYPRSTPEMWPGLIQKAKEGGLDVIQTYVFWNGHEPARGQYHFADRYDLVRFVKLAGQAGLYVHLRIGPYVCAEWNFGGFPVWLKYVPGISFRTDNGPFKAEMQRFVEKIVSMMKSRACSSRRAGPSILAQVENEYGPMESAMGAGAKPYANWAAKMAVATDAGVPWVMCKQDDAPDPVINTCNGFYCDYFSPNSNSKPTMWTEAWTGWFTAFGGAVPHRPVEDMAFAVARFVQKGGSFVNYYMYHGGTNFDRTAGGPFIATSYDYDAPIDEYGLIRQPKWGHLRDLHKAIKQAEPALVAGDPTVQRIGNYEKAYVFKSSTGACAAFLSNYHTSSAARVVYNGRRYDLPAWSISILPDCKTAVFNTATVKEPSLPARMNPAGGFAWQSYSEDTNALDSSAFTKDGLVEQLSMTWDKSDYLWYTTYVNIDSSEQFLKSGQWPQLTINSAGHSVQVFVNGQSFGVAYGGYNSPKLTYSKPVKMWQGSNKISILSSAMGLPNQGTHYEAWNVGVLGPVTLSGLNQGKRDLSNQKWTYQIGLKGESLGVNSISGSSSVEWSSASGAQPLTWHKAYFAAPAGSAPVALDMGSMGKGQIWVNGNNAGRYWSYRASGSCGACSYTGTFSEAKCQTNCGDISQRWYHVPRSWLKPSGNLLVVLEEFGGDLSGVTLMTRTT

SEQ ID NO: 4308 - protein, 715 aa, Oryza sativa
MSGGAVAFLLLVAAAAVANAAVTYDHRSLTINGQRRILISGSIHYPRSTPEMWPDLIQKAKDGGLDVIQTYVFWNGHEPVQGQYYFSDRYDLVRFVKLVKQAGLYVNLRIGPYVCAEWNYGGFPVWLKYVPGISFRTDNGPFKAAMQTFVEKIVSMMKSEGLFEWQGGPIILAQVENEYGPMESVMGSGAKSYVDWAAKMAVATNAGVPWIMCKQDDAPDPVINTCNGFYCDDFTPNSKNKPSMWTEAWSGWFTAFGGTVPQRPVEDLAFAVARFIQKGGSFINYYMYHGGTNFDRTAGGPFIATSYDYDAPIDEYGLLRQPKWGHLTNLHKAIKQAETALVAGDPTVQNIGNYEKAYVFRSSSGDCAAFLSNFHTSAAARVAFNGRRYDLPAWSISVLPDCRTAVYNTATVTAASSPAKMNPAGGFTWQSYGEATNSLDETAFTKDGLVEQLSMTWDKSDYLWYTTYVNIDSGEQFLKSGQWPQLTVYSAGHSVQVFVNGQYFGNAYGGYDGPKLTYSGYVKMWQGSNKISILSSAVGLPNVGTHYETWNIGVLGPVTLSGLNEGKRDLSKQKWTYQIGLKGEKLGVHSVSGSSSVEWGGAAGKQPVTWHRAYFNAPAGGAPVALDLGSMGKGQAWVNGHLIGRYWSYKASGNCGGCSYAGTYSEKKCQANCGDASQRWYHVPRSWLNPSGNLVVLLEEFGGDLSGVTLMTRTT

SEQ ID NO: 4309 - protein, 724 aa, Triticum aestivum
MVPPLVAGGGLLLAAFVAFSLAASSANAAVSYDHRSLLINGRRRILISGSIHYPRSTPEMWPGLIQKAKDGGLDVIQTYVFWNGHEPVKGQYYFSDRYDLVRFVKLAKQAGLYVHLRIGPYVCAEWNFGGFPVWLKYVPGISFRTDNGPFKAEMQRFVEKIVSMMKSERLFEWQGGPIIMSQVENEFGPMESVGGSGAKPYANWAAKMAVATNTGVPWVMCKQEDAPDPVINTCNGFYCDYFTPNKKNKPTMWTEAWTGWFTSFGGAVPHRPVEDMAFAVARFIQKGGSFVNYYMYHGGTNFGRTAGGPFIATSYDYDAPIDEYGLLRQPKWGHLRDLHKAIKQAEPVLVSGDPTVQSLGNYEKAYVFKSKNGACAAFLSNYHMNAAVKVRFNGRHYDLPAWSISILPDCKTAVFNTATVKEPTLLPKMHPVVRFAWQSYSEDTNSLDGSAFTKNGLVEQLSMTWDKSDYLWYTTYVNIGANELAKNGQWPQLTIYSAGHSMQVFVNGKSYGSVYGGYNNPKLTYDGHVKMWQGSNKISILSSAVGLPNDGNHFERWNVGVLGPVTVSGLNSGKRDLSHQKWTYQVGLKGESLGLHTVAGSSSVEWGGPGNKQPLTWHKALFTAPVGSDPVALDMGSMGKGQMWVNGHHVGRYWSYKAPSGGCGRCSYAGTYRQDKCRSNCGELSQRWYHVPRSWLKPGGNLLVVLEEYGGDLTGVAMATRRTT

SEQ ID NO: 4310 - protein, 724 aa, Hordeum vulgare
MAPPLVAGGRLLLATFVAFYLAASWANAAVSYDHRSLVINGRRRILISGSIHYPRSTPEMWPGLIQKAKDGGLDVIQTYVFWNGHEPVKGQYYFRDRYDLVRFVKLAKQAGLYVHLRIGPYVCAEWNFGGFPVWLKYVPGISFRTDNGPFKAEMQRFVEKIVSMMKSERLFEWQGGPIIMSQVENEFGPMESVGGSGAKPYTNWAAKMAVATNTGVPWVMCKQEDAPDPVINTCNGFYCDYFTPNKKNKPTMWTEAWTGWFTSFGGAVPHRPVEDMAFAVARFIQKGGSFVNYYMYHGGTNFGRTAGGPFIATSYDYDAPIDEFGLLRQPKWGHLRDLHKAIKQAEPILVSGDPTIQSLGNYEKAYVFKSKNGACAAAFLSNYHMNAAVKVRFNGRHYDLPAWSISILPDCKTAVFNTATVKEPTLLPKMHPVVWFSWQSYSEDTNSLDDSAFTKNGLVEQLSMTWDKSDYLWYTTYVNIGANELPKNGQWPELTIYSAGHSMQVFVNGKSYGSVYGGYENPKLTYDGHVKMWQGSNKISILSSAVGLPNDGNHFERWNVGVLGPVTVSGLNTGKRDLSHQKWTYQVGLKGESLGLHTVTGSSSVEWGGPGNKQPLTWHKALFNAPAGSDPVALDMGSMGKGQMWVNGHHVGRYWSYKAPSGGCGRCSYAGTYRQDKCRSNCGEPSQRWYHVPRSWLKPGGNLLVVLEEYGGDLAGVAMATRRT

SEQ ID NO: 4311 - protein, 638 aa, Setaria italica
VQGQYYFGDRYDLVRFVKLAKQAGLLVHLRIGPYVCAEWNFGGFPVWLKYVPGISFRTDNGPFKAAMQAFVEKIVSMMKAEGLFEWQGGPIILAQVENEYGPMESVMGGGAKPYASWAAKMAVATGAGVPWVMCKQDDAPDPVINTCNGFYCDYFTPNSNSKPTMWTEAWSGWFTAFGKPVPHRPVEDLAFAVARFIQKGGSFVNYYMYHGGTNFDRTSGGPFIATSYDYDAPIDEYGLLRQPKWGHLRDLHKAIKQAEPALVSGDPTVQSIGNYEKAYVFKSSGGACAAFLSNYKTNAPATVVFNGRRYELPAWSISVLPDCKTAVFNTATVKEPSAPATMSPAGGFSWRSYSEATNSLDDRAFTKDGLVEQLSMTWDKSDYLWYTTYVNIDSSEQFLKSGKWPQLTIYSAGHALQVFVNGQSYGTAYGGYDSPKLTYSGYVKMWQGSNKISILSAAVGLPNQGTHYETWNVGVLGPVTLSGLNEGKRDLSNQKWTYQIGLHGESLGVHTAAGSSSVEWGGAAGNQPLTWHRAYFNAPAGGAPVALDLGSMGKGQAWVNGHHIGRYWSYKAAGGGGCGGCGYAGTYSETKCQSGCGDVSQRYYHVPRSWLNPSGNLVVLLEEFGGNLSGVTLVTRTA

SEQ ID NO: 4312 - protein, 660 aa, Triticum aestivum
LIQKAKDGGLDVIQTYVFWNGHEPARGQYHFADRYDLVRFVKLAKQAGLYVHLRIGPYVCAEWNFGGFPVWLKYVPGISFRTDNGPFKAEMQRFVEKIVSMMKSEGLFEWQGGPIILAQVENEYGPMESAMGAGAKPYANWAAKMAVATDAGVPWVMCKQDDAPDPVINSCNGFYCDYFSPNSNGKPTMWTEAWTGWFTAFGGPVPHRPVEDMAFAVARFIQKGGSFVNYYMYHGGTNFDRTAGGPFIATSYDYDAPIDEYGLIRQPKWGHLRDLHKAIKQAEPALVSGDPTVQRIGNYEKAYVFKSSTGACAAFLSNYHTSAAARVVYNGRRYDLPAWSISILPDCKTAVFNTATVKEPSLPAKMNPAGGLAWQSYSEDTNALDSSAFTKDGLVEQLSMTWDKSDYLWYTTYVNIDSSEQFLKSGQWPQLTINSAGHSVQVFVNGQSFGVAYGGYNNPKLTYSKPVKMWQGSNKISILSSAMGLPNQGTHYEAWNVGVLGPVTLSGLNQGKRDLSNQKWTYQIGLKGESLGVNSISGSSSVEWSSATGAQPLTWHKAYFAAPAGSAPVALDMGSMGKGQIWVNGNNAGRYWSYRASGSCGACSYAGTFSEAKCQTNCGDISQRWYHVPRSWLKPSGNLLVVLEEFGGDLSGVTLMTRTT

SEQ ID NO: 4313 - protein, 724 aa, Brachypodium distachyon
MAPPRVAGGRGLLLLLAVLAALCFAVANAAVSYDHRSLVINGRRRILISGSIHYPRSTPEMWPGLIQKAKDGGLDVVQTYVFWNGHEPVKGQYYFSDRYDLIRFVKLVKQAGLYVHLRIGPYVCAEWNFGGFPVWLKYVPGISFRTDNGPFKAEMQRFVEKIVSMMKSERLFEWQGGPIIMSQVENEFGPMESAGGVGAKPYANWAAKMAVATNTGVPWVMCKQEDAPDPVINTCNGFYCDYFTPNKKNKPAMWTEAWTGWFTSFGGAVPHRPVEDMAFAVARFIQKGGSFVNYYMYHGGTNFGRTAGGPFVATSYDYDAPIDEFGLLRQPKWGHLRDLHKAIKQAEPTLVSGDPTIQSLGNYEKAYVFKSKNGACAAFLSNYHMNSAVKVRFNGRHYDLPAWSISILPDCKTVVFNTATVKEPTLLPKMHPVVRFTWQSYSEDTNSLDDSAFTKDGLVEQLSMTWDKSDYLWYTTFVNIGPGELSKNGQWPQLTVYSAGHSMQVFVNGKSYGSVYGGFENPKLTYDGHVKMWQGSNKISILSSAVGLPNVGDHFERWNVGVLGPVTLSGLSEGKRDLSHQKWTYQVGLKGESLGIHTVSGSSAVEWGGPGSKQPLTWHKALFNAPSGSDPVALDMGSMGKGQMWVNGHHVGRYWSYKAPSRGCGGCSYAGTYREDKCRSSCGELSQRWYHVPRSWLKPGGNLLVVLEEYGGDVAGVTLATRTQ

SEQ ID NO: 4314 - protein, 736 aa, Zea mays
MAAAPRSLVTCSGGGSSSSRILLAVFLAAALLASAANAAVSYDHRSLVINGRRRILISGSIHYPRSAPEMWPGLIQKAKDGGLDVVQTYVFWNGHEPAQGQYYFADRYDLVRFVKLVRQAGLYVHLRVGPYVCAEWNFGGFPVWLKYVPGIRFRTDNGPFKAAMQKFVEKIVSMMKSEGLFEWQGGPIIMAQVENEFGPMESVVGSGGKPYAHWAAQMAVGTNAGVPWVMCKQDDAPDPVINTCNGFYCDYFTPNNKHKPTMWTEAWTGWFTKFGGAAPHRPVEDLAFAVARFVQKGGSFVNYYMYHGGTNFGRTAGGPFIATSYDYDAPIDEFGLLRQPKWGHLRNMHRAIKQAEPALVSGDPTIRSIGNYEKAYVFKSKNGACAAFLSNYHVKSAVRIRFDGRHYDLPAWSISILPDCKTAVFNTATVKEPTLLPKMSPVMHRFAWQSYSEDTNSLDDSAFARDGLIEQLSLTWDKSDYLWYTTHVNIGSNERFLKSGQWPQLSVYSAGHSMQVFVNGRSYGSVYGGYDNPKLTFSGYVKMWQGSNKISILSSAVGLPNNGDHFELWNVGVLGPVTLSGLNEGKRDLSHQRWIYQVGLKGESLGLHTVTGSSAVEWAGPGGGTQPLTWHKALFNAPAGSDPVALDMGSMGKGQVWVNGRHAGRYWSYRAHSRGCGRCSYAGTYREDQCTSNCGDLSQRWYHVPRSWLKPSGNLLVVLEEYGGDLAGVSLATRTT

SEQ ID NO: 4315 - protein, 740 aa, Sorghum bicolor
MAAARRLLAACSSGGGAGAGAGSRILLAVFFLAASLLASAANAAVSYDHRSLVINGRRRILISGSIHYPRSTPEMWPGLIQKAKDGGLDVIQTYVFWNGHEPVQGQYHFADRYDLVRFVKLVRQAGLYVHLRIGPYVCAEWNFGGFPVWLKYVPGIRFRTDNGPFKAAMQKFVEKIVSMMKSEGLFEWQGGPIIMAQVENEFGPMESVVGSGAKPYAHWAAQMAVGTNTGVPWVMCKQDDAPDPVINTCNGFYCDYFTPNRKYKPTMWTEAWTGWFTKFGGALPHRPVEDLAFAVARFIQKGGSFVNYYMYHGGTNFGRTAGGPFIATSYDYDAPIDEFGLLRQPKWGHLRDLHRAIKQAEPALISGDPTIQSIGNYEKAYIFKSKNGACAAFLSNYHMKTAVKIRFDGRHYDLPAWSISILPDCKTAVFNTATVKEPTLLPKMNPVLHFAWQSYSEDTNSLDDSAFTRNGLVEQLSLTWDKSDYLWYTTHVSIGGNEQFLKSGQWPQLTVYSAGHSMQVFVNGRSYGSVYGGYDNPKLTFNGHVKMWQGSNKISILSSAVGLPNNGNHFELWNVGVLGPVTLSGLNEGKRDLSHQKWTYQVGLKGESLGLHTVTGSSAVEWAGPGGKQPLTWHKALFNAPAGSDPVALDMGSMGKGQIWVNGHHAGRYWSYRAYSGSCRRCSYAGTYREDQCLSNCGDISQRWYHVPRSWLKPSGNLLVVLEEYGGGDLAGVTLATRTT

SEQ ID NO: 4316 - protein, 224 aa, Setaria italica
MAGAPPLLVSASGGGRTLLAAFLAASLLAAAANASVLYDHRSLVINGRRRILISGSIHYPRSTPEMWPGLIQKAKDGGLDVIQTYVFWNGHEPVQGQYHFADRYDLVRFIKLVKQAGLYVHLRIGPYVCAEWNFGGFPVWLKYVPGIRFRTDNGPFKAAMQKFVEKIVSMMKSEGLFEWQGGPIIMAQVENEFGPMESVVGSGAQPYAIGQPRWRLGPTPACLG

SEQ ID NO: 4317 - protein, 729 aa, Oryza sativa
MAPAPTPAAAAGRRVAVLAAALVAASLAASVGVANAAVSYDRRSLVINGRRRILLSGSIHYPRSTPEMWPGLIQKAKDGGLDVIQTYVFWNGHEPVQGQYYFSDRYDLVRFVKLVKQAGLYVHLRIGPYVCAEWNFGGFPVWLKYVPGVSFRTDNGPFKAEMQKFVEKIVSMMKSEGLFEWQGGPIIMSQVENEFGPMESVGGSGAKPYANWAAKMAVGTNTGVPWVMCKQDDAPDPVINTCNGFYCDYFSPNKNYKPSMWTEAWTGWFTSFGGGVPHRPVEDLAFAVARFIQKGGSFVNYYMYHGGTNFGRTAGGPFIATSYDYDAPIDEFGLLRQPKWGHLRDLHRAIKQAEPVLVSADPTIESIGSYEKAYVFKAKNGACAAFLSNYHMNTAVKVRFNGQQYNLPAWSISILPDCKTAVFNTATVKEPTLMPKMNPVVRFAWQSYSEDTNSLSDSAFTKDGLVEQLSMTWDKSDYLWYTTYVNIGTNDLRSGQSPQLTVYSAGHSMQVFVNGKSYGSVYGGYDNPKLTYNGRVKMWQGSNKISILSSAVGLPNVGNHFENWNVGVLGPVTLSSLNGGTKDLSHQKWTYQVGLKGETLGLHTVTGSSAVEWGGPGGYQPLTWHKAFFNAPAGNDPVALDMGSMGKGQLWVNGHHVGRYWSYKASGGCGGCSYAGTYHEDKCRSNCGDLSQRWYHVPRSWLKPGGNLLVVLEEYGGDLAGVSLATRTT

SEQ ID NO: 4318 - protein, 570 aa, Saccharum officinarum
MDLHQLLKYRLTGDNVFYEFPTENNLANTPWPASPLKSEFSSSPYTPLSSQLECDNLSALSNTPDNQSSTETISAQPISPLEVDSSYRQAAILRENTQVRPDPLYATSRHNMQHALREIETVLMAPDAEDAATSTKHEFVEHKPAQLMRQRSRTWSHESRQPSPGVVRTQFASGYPTASYEFRPEKRLRELREDPQSMVKQLLTKCAEALSEERIEEFLNLVQQARAVVSITGEPIQRLGAYLLEGLVARHANSGTNIYRALKCREPESNELLSYMKILYNICPYFKFGYMAANGAIAEALRNEDKIHIIDFQIAQGTQWITLIQALAARPGGPPHVRITGIDDPVSEYARGEGLDLVGKMLKSMSEEFKIPLEFTPLPGIYATQVTKEMLDIRPGEALAVNFTLQLHHTPDESVDVNNPRDGLLRMVKGLSPKVTTLVEQESHTNTTPFLMRFTETLDYYSAMFESIDTNLPRENKERINVEQHCLAKDIVNIIACEGKDRVERHELLGKWRSRLTMAGFRPYPLSSYVNSVIRKLLACYSDKYTLEEKDGAMLLGWKNRKLISASAWH

SEQ ID NO: 4319 - protein, 570 aa, Sorghum bicolor
MDLHQLLKYRLTGANVFYEFPTENNLANTPWPASPLKSEFSGSPYTPLSSQLECDNLSALSNTPDNQSSTETISAQPISPLEVDSSYRQAAILRENTQVRPDPLYATSRHNMQHALREIETVLMAPDAEDAATSTKHEFEEHKPAQLMRQRSRTWSHESRQPSPGVVRTQFASGYPTASYEFRPEKRLRELREDPQSMVKQLLTKCAEALSEERIEEFLTLVQQARGVVSITGEPIQRLGAYLLEGLVARHANSGTNIYRALKCREPESNELLSYMKILYNICPYFKFGYMAANGAIAEALRNEDKIHIIDFQIAQGTQWITLIQALAAKPGGPPHVRITGIDDPVSEYARGEGLDLVGKMLKSMSEEFRIPLEFTPLPGIYATQVTKEMLDIRPGEALAVNFTLQLHHTPDESVDVSNPRDGLLRMVKGLSPKVTTLVEQESHTNTTPFLMRFTETLDYYSAMFESIDANLPRENKERINVEQHCLAKDIVNIIACEGKDRVERHELLGKWRSRLTMAGFRPYPLSSYVNSVIRNLLAYYSDKYTLEEKDGAMLLGWKNRKLISASAWH

SEQ ID NO: 4320 - protein, 570 aa, Setaria italica
MDLHQLLKYRLTGANVFYEFPTENNLANNPWPGTPLKSEFSNSPYTPLSAQLECDNLSAISNTPDNQSSTETISAQPISPLEVDSSNRQAGILWENTQVRPDHLYTTSRHNMQHALRKIETVLMAPDADDAATSTKHEFEEHKPAPLMRQRSRTWSHELRQPSPGVVRTQFASGYPTASYEFRPEKRQRELREDPQSMVKQLLTKCAEALSEERIEEFLKLVQQARGVVSITGEPIQRLGAYLLEGLVARHGNSGTNIYRALKCREPESNELLSYMKILYNICPYFKFGYMAANGAIAEALRNEDKIHIVDFQIAQGTQWITLIQALAARPGGPPHVRITGIDDPVSEYARGEGLDLVGKMLKSMSEEFRIPLEFTPLPGVYATQVTKEMLDIRPGEALAVNFTLQLHHTPDESVDVNNPRDGLLRMVKGLSPKVTTLVEQESHTNTTPFLMRFSETMDYYSAMFESIDANLPRDSKERINVEQHCLAKDIVNIIACEGKDRVERHELLGKWKSRLTMAGFKPYPLSSYVNSVIRKLLACYSDKYTLEEKDGAMLLGWKSRKLISASAWH

SEQ ID NO: 4321 - protein, 569 aa, Panicum virgatum
MDLHQLLKYRLAGANVFYEFPTENNLANIPWPVSPLKSEFSNSPYTLSAQLECDNLSAISNTPDNQSSTETISAQPISPLEVDSSYRQAGILRENTQVRPDPLYATSRHNMQHTLREIETVLMAPDADDAANGTKHEFEEHKPTQLMRQRSRTWSHESRQPSPGVVRTQFGSGYPTASYDFRPEKRQRELREDPQSMVKQLLTKCAEALSEERIDEFFKLVQQARGVVSITGEPIQRLGAYLLEGLVARHGNSGTNIYRALKCREPESNELLSYMKILYSICPYFKFGYMAANGAIAEALRNEDKIHIIDFQIAQGTQWITLIQALAARPGGPPHVRITGIDDPVSEYARGEGLDLVGKMLKSMSEEFRIPLEFTPLPGFYATRVTKEMLDIRPGEALAVNFTLQLHHTPDESVDVNNPRDGLLRMVKGLSPKVTTLVEQESHTNTTPFLMRFSETMDYYSAMFESIDVNLPRDSKERINVEQHCLAKDIVNIIACEGKDRVERHELLGKWKSRLTMAGFKPYPLSSYVNSVIRRLLACYSDKYTLEEKDSAMLLGWKNRKLISASAWH

SEQ ID NO: 4322 - protein, 565 aa, Pennisetum glaucum
MDLHQLLKYRLTGANVFYEFPTENNLANNPWPGTPVKSQFSNCTPLSTQLECDNLSAICNTSDNQSSTETISAQPISPLEVDSSNRQAGILRENTQVRPDQLYTTSRHNMQHTLREIETVLMAPDADDAATITKHEFEEHKPALLMRQRSRTWSRESRQPSPGVVRAQFASRYPTTSCEFRPEKRQREDPQSMVKQLLTKCAEALSEERIEEFLKLVQQARGVVSITGEPIQRLGAYLLEGLVARHGNSGTNIYRALKCREPESNELLSYMKILYNICPYFKFGYMAANGAIAEALRNEDNIHIIDFQIAQGTQWITLIQALAARPGGPPHVRITGIDDPVSEYARGEGLDLVGKMLKSMSEEFRIPLEFTPLPGVYATEVTKEMLDIRPGEALAVNFTLQLHHTPDESVDVNNPRDGLLRMVKGLSPKVTTLVEQESHTNTTPFLMRFSETMDYYSAMFESIDANLPRDSKERINVEQHCLAKDIVNIIACEGKDRVERHELLGKWKSRLTMAGFKPYPLSSYVNSVIRKLLGCYSDKYTLEEKDGAMLLGWKSRKLISASAWH

SEQ ID NO: 4323 - protein, 571 aa, Oryza sativa
MDLHQLLKYRLTGANVVYEIPTENNLQNSPWQANPLKYEFSDSPYTPLSSQFECDNLSALTNTPDNQSSTETISAQPISPLEADSSYRQAGILLQENIQVGADPLYATSRHNMQHALREIETVLMAPDTDDATTSTKHEFEEIKPAQLVRQRSRTWSHESRQPLPGVGRSQFASGGYPTASYEFRPEKRQRELREDPQIIVKQLLTRCAEALSEDRTEEFHKLVQEARGVVSINGEPIQRLGAYLLEGLVARHGNSGTNIYRALKCREPESKELLSYMRILYNICPYFKFGYMAANGAIAEALRTENNIHIIDFQIAQGTQWITLIQALAARPGGPPRVRITGIDDPVSEYARGEGLDIVGKMLKSMSEEFKIPLEFTPLSVYATQVTKEMLEIRPGEALSVNFTLQLHHTPDESVDVNNPRDGLLRMVKGLSPKVTTLVEQESHTNTTPFLMRFGETMEYYSAMFESIDANLPRDNKERISVEQHCLAKDIVNIIACEGKDRVERHELLGKWKSRLTMAGFRPYPLSSYVNSVIRKLLACYSDKYTLDEKDGAMLLGWRSRKLISASAWH

SEQ ID NO: 4324 - protein, 571 aa, Brachypodium distachyon
MDLHQLLKYRLTGANVLYEIPTENNLTNSSWPASPLKLEYNNSPYTPLSTQLECDNLSALSNTPDNQSSTETISAQPISPLEADSSYIQPGSHLRENIQVRADPLYARSRHNMQHALREIETVLMAPDADDATTSAKHEFEETKPAQLMRQRSRTWSHESRQPLPGVVRPQFASGGYPMASYEFRPEKRQRELRDDPQIIVKQLLTKCAEALSEDRTEEFLKLVQEARGIVSINGEPIQRLGAYLLEGLVARHGNSGRNIYRALRCRKPESKELLSYMKILYNICPYFKFGYMAANGAIAEALRSEDNIHIIDFQIAQGTQWITLIQALAARPGGPPHVRITGIDDPVSEYARGEGLEIVGNMLKGMSKEFNIPLEFTPLPVYATQVTKEMLEIRPGEALAVNFTLQLHHTPDESVDVNNPRDGLLRMVKGLSPKVTTLVEQESHTNTTPFMMRFAETMDYYSAMFESIDANLPRDNKERISVEQHCLAKDIVNIIACEGKDRVERHELLGKWKSRLTMAGFKPYPLSSYVNSVIKKLLACYSDKYTLEEKDGAMLLGWKKRKLISASAWH

SEQ ID NO: 4325 - protein, 570 aa, Secale cereale
MDLHQLFKYRLTGANVFCEIPTENNLANSSWQTSPLKLEFSNSPYTPLSTQLECDNLSALSNTPDNQSSTETISAQPISPLEADSSYIKAGSIRENIQVRSDPLYATSRHNMQQTLRDIENVLMAPDADDATTSTKHEFEDTKPAQLMRQRSRTWSHESRQPLPGVVRPHFASGGYPTASYEFRPEKRQRELRDDRQHIVKDLLTKCAEALSEDRTEEFLKLVQEARGTVSINGEPIQRLGAYLLEGLVARHGNSGTNIYRALKCREPESKELLSYMKILYNICPYFKFGYMAANGAIAEALRSEDNIHIIDFQIAQGTQWITLIQALAARPGGPPHVRITGIDDPVSEYARGEGLEIVGNMLKSMSKEFNIPLEFTPLSVYATQVTKEMLEIRPGEAVAVNFTLQLHHTPDESVDVNNPRDGLLRMVKGLSPKVTTLVEQESHTNTTPFLMRFLETMDYYSAMFESIDANLPRDSKERISVEQHCLAKDIVNIIACEGKDRVERHELLGKWKSRLSMAGFKPYPLSSYVNSVIKKLLACYSDKYTLEEKDGAMLLGWKTRKLISASAWH

SEQ ID NO: 4326 - protein, 570 aa, Triticum aestivum
MDLHQLFKYRLTGANVFCEIPTENNLANSSWQTSPLKLEFSNSPYTPLSTQLECDNLSALSNTPDNQSSTETISAQPISPLEADSSYIKAGSIRENIQVRPDPLYATSRHNMQQTLRDIENVLMAPDADDATTSTKHEFEDTKPAQLMRQRSRTWSHESRQPLPGVVRPHFASGGYPTASYEFRPEKRQRELRDDRQHIVKGLLTKCAEALSEDRTEEFLKLVQEARGTVSINGEPIQRLGAYLLEGLVARHGNSGTNIYRALKCREPESKELLSYMKILYNICPYFKFGYMAANGAIAEALRSEDNIHIIDFQIAQGTQWITLIQALAARPGGPPHVRITGIDDPVSEYARGEGLEIVGNMLTSMSKEFNIPLEFTPLSVYATQVTEEMLKIRPGEAVAVNFTLQLHHTPDESVDVNNPRDGLLRMVKGLSPKVTTLVEQESHTNTTPFLMRFLETMDYYSAMFESIDANLPRDSKERISVEQHCLAKDIVNIIACEGKDRVERHELLGKWKSRLSMAGFKPYPLSSYVNSVIKKLLACYSDKYTLEEKDGAMLLGWNTRKLISASAWH

SEQ ID NO: 4327 - protein, 570 aa, Hordeum vulgare
MDLHQLFKYRLTGANVFCEIPTENNLVNSSWQTSPLKLEFSNSPYTPLSTQLECDNLSALSNTPDNQSSTETISAQPISPLEADSSYIKAGGISENIQVRSDPLYATSRHNMQQTLRDIENVLMAPDADDATTSANHEFEDTKPSQLMRQRSRTWSHESRQPLPGVVRPQFASGGFPTASYEFRPEKRQRELREDPQLIVKHLLVKCAEALSENRTEEFLKLVQEARGTVSINGEPIQRLGAYLLEGLVARHGNSGTNIYRALKCREPESKELLSYMKILYNICPYFKFGYMAANGAIAEALRSEDKIHIIDFQIAQGTQWITLIQALAARPGGPPHVRITGIDDPVSEYARGEGLELVGNMLKNMSEEFNIPLEFTPLSVYATQVTKEMLEIRPGEAVAVNFTLQLHHTPDESVDVNNPRDGLLRMVKGLSPKVTTLVEQESHTNTTPFLMRFVETMDYYSAMFESIDANLPRDSKERISVEQHCLAKDIVNIIACEGKDRVERHELLGKWKSRLSMAGFKPYPLSSYVNSVIKKLLACYSDKYTLEEKDGAMLLGWKSRKLISASAWH

SEQ ID NO: 4328 - protein, 138 aa, Saccharum officinarum
MAGGKVYSFEEVRKHSDCKDCWLIIAGKVYDVTPFMEEHPGGDEVLLACVGKDATADFEDIGHTDSAKELMPQYCIGEVDAATIPAKLTHVVTKDASRSEKATTSAAGNWATLLQLAVPVLLLALAFALQNYSRAKAE

SEQ ID NO: 4329 - protein, 140 aa, Sorghum bicolor
MAGGKVYSFEEVRKHSDRKDCWLIIAGKVYDVTPFMEEHPGGDEVLLACVGKDATADFEDIGHTDSAKELMPQYCVGEVDAATIPAKLTHAVVTKDAASRSEKTTTASAGTWATLLQLALPVLLLALAFALQNYSRAKAA

SEQ ID NO: 4330 - protein, 355 aa, Sorghum bicolor
MVGMGKQQQQQGEAEGKIVLQEETAPVPPPEEDKEAEAALVHKISSLAAAIGKLPSLSPSPEVNALFTELVTACIPRSTVDVERLGPELQEMRGRLIRLCADAEGLMEAHYSDLLAAFDNPLDHLSLFPYFNNYILLSQLEHGLLARHVPAPPPSRVAFVGSGPLPLSSLVLAARHLPAASFDNYDISGDANDRARRLVRGDAALQARMAFRTSDVANVNRELASYDVVFLAALVGMAAEDKARVVEHLGRHMAPGAALVVRSAHGARGFLYPVVDPEEIRRGGFDVLAVHHPEGEVINSVIIARKPVAVDGVGVAELGHAHAHGAVLSRPCLCCEMEARAHQKMEEVAMEQLPS

SEQ ID NO: 4331 - protein, 363 aa, Sorghum bicolor
MVVMGKEEEKHHQQQQLKEEEVQEEARVVVEPDMTADEEALVQKISGLAAAIAKLPSLSPSPEVNALFTALVTACIPRSTVDVERLGPELQAMRAGLIRLCADAEALLEAHYSDLLAGFDNPLDHLTLFPYFSNYLLLSELEHGLLARHVPGPPPARVAFVGSGPLPLSSLVLAARHLPAAAFDNYDICGDANDRARRLVRADAALAARMAFRTSDVADVTRDLAGYDVVFLAALVGMAAEEKARVVEHLGRHMAPGAALVVRSAHGARGFLYPVVDPEEIRRGGFDVLAVHHPEGEVINSVIIARKPVPPVDAHAVAVAAAGVGHAHAHAHGAVLSRPCLCCEMEARAHQKMEEVAVEQLPS

SEQ ID NO: 4332 - protein, 359 aa, Zea mays
MAVMGKEEEEQQQQHKEEEVVQGDVRVVVQQETAADEEAESALVRKISGLAAAIARLPSLSPSPEVNALFTDLVTACIPRSTVDVERLGPELQRMRAGLIRLCADAEALLEAHYSDLLAAFDNPLDHLPLFPYFTNYLLLSQLEHGLLARHVPGPPPSRVAFVGSGPLPLSSLVLASRHLPAAAFDNYDICGDANDRARRLVRADAALAARMAFRTSDVAHVTRELAAYDVVFLAALVGMAAEEKARVVEHLGRHMAPGAALVVRSAHGARGFLYPVVDPEEIRRGGFDVLAVHHPEGEVINSVIIARKPLPVVDEHAVAGVGHAHAHGAVLSRPCLCCEMEARAHQKMEEVAMEQLPS

SEQ ID NO: 4333 - protein, 344 aa, Setaria italica
MVDMGNKQEEEVQVPVPEEGMASDEEAALVHKIAGLAAAIAKLPSLSPSPEVNALFTELVTACIPPSAVDVERLGPELQEMRARLIRLCADAEGLLEAHYSDLLAGFDNPLDHLGLFPYFNNYILLSELEHGLLASHVPGPVPARVAFVGSGPLPLSSLVLAARHLPAASFDNYDICGEANERARRLVRADAGLGARMAFRTSDVAHVTRDLASYDVVFLAALVGMAAEEKARVVEHLGRHMAPGAALVVRSAHGARGFLYPVVDPEEIRRGGFEVLAVHHPEGEVINSVIIARKPVPADAQAGGGVAHAHAHGAVLSRPCLCCEMEARAHQKMEEVALEQLPS

SEQ ID NO: 4334 - protein, 333 aa, Saccharum officinarum
MDGLPDADAAPLAAAPPQKRDEWSESGIVRLLEAYEAKWLLRNRAKLKWSDWVDIAREVSVHCADDAAAAGKPPGGGGGNSAKTPNQCKNKIESMKKRYRAESAAVARAGPAAAGPSWRFFARMDGLLKGPAVCSAQVQQPELINSIDLRAPAKPEVAEVEADFATQLRDAVPGAFSDLMNIDTNGAVPDKAEKVDNSMQKEVRPADSDANVSSPRSKVANEDVEEVNNVWDRTKKRKSTDFDIAKSIELLASSFLKIEHARLEMYRETERMRVEAEIKKGEMELKRTEIMAKTHLQIARLFAKKLKQSSGKNGGSSSVTAEVDTLTKKGENG

SEQ ID NO: 4335 - protein, 337 aa, Sorghum bicolor
MDGLPDPDAAPLAAAPPQKRDEWSESGIVRLLEAYEAKWLLRNRAKLKWSDWVDIAREVSVHCADDAAAAGKPPGGGGGGNSAKTPNQCKNKIESMKKRYRAESAAVARAGPAAAGPSWRFFGRMDGLLKGPPVCSAQVQPPELVNSIDLRAPAKPEAAEVEADFPTQLRDAVPGALSDLMNIDANGAAVPEKAEKVDNSMHKECRPADSDANVSSPRSKVANEDVEEVNNVWDRTKKRKSTDFDIAKSIELLASSFLKIEHARLEMYRETERMRVEAEIKKGEMELKRTEIMAKTHLQIARLFAKKLKQSSGKNGGSSSVTAEVDTLTKKGENGSG

SEQ ID NO: 4336 - protein, 335 aa, Sorghum bicolor
MDGLPDPDAAPLAAAPPQKRDEWSESGIVRLLEAYEAKWLLRNRAKLKWSDWVDIAREVSVHCADDAAAAGKPPGGGGGGNSAKTPNQCKNKIESMKKRYRAESAAVARAGPAAAGPSWRFFGRMDGLLKGPPVCSAQVQPPELVNSIDLRAPAKPEAAEVEADFPTQLRDAVPGALSDLMNIDANGAAVPEKAEKVDNSMHKECRPADSDANVSSPRSKVANEDVEEVNNVWDRTKKRKSTDFDIAKSIELLASSFLKIEHARLEMYRETERMRVEAEIKKGEMELKRTEIMAKTHLQIARLFAKKLKQSSGKNGGSSSVTAEVDTLTKKGENG

SEQ ID NO: 4337 - protein, 334 aa, Zea mays
MDGLPDADAAPLAAAPPQKRDEWSESGIARLLEAYEAKWLLRNRAKLKWSDWVDIAREVSVHCADDAAAAGKPPGGVGSSAKTPNQCKNKVESMKKRYRAETAAVARAGPAAAGPSWRFFARMDGLLKGPPVGPDQVQQQQALTNSRIDLRAPAKPEAEAEADFAAQLRDAVPGAFTDLMNMDANGAVPDKAEKADNSMQKESGPADSDANVSSPRSKVANEDVEEVEDKVWDRPKKRKSTDFDIAKSIELLASSFLKVEQARMEMYRETERMRVEAEIKKGEMELKRTEIMAKTHLQIARLFARKLKQSSGKNGGSSSVTAEVDTLTKKGENG

SEQ ID NO: 4338 - protein, 337 aa, Setaria italica
MNGLPDADAAAPLATAAPPQKRDEWSEGGIVRLLEAYEAKWLLRNRAKLKWSDWVDIAREVSAHCADDAAAAGKAPGGGGGNSAKTPNQCKNKIESMKKRYRAESAAVARAGPAAAGPSWRFFARMDGLLKGPAICSGQVPQAELGNSIDLRAPAKAEAEVVEADFAAQLPDAGPGAFSDLMNIDTNGAVPEKAEKVDNSVQKESRAADSDANVSSPRSKVANEDVEEVDKVRDRPKKRKSTEFDIAKSIELLASSYLKIEHARMEMYRETERMRAEAEIKKGEMELKRTEIMAKTHLQIAKLFAKRLKEGSGKTGGSSSVTAEVDTHTKKGENGSG

SEQ ID NO: 4339 - protein, 322 aa, Pennisetum glaucum
APPQKRDEWSEGGIVRLLEAYEAKWLLRNRAKLKWSDWIDIARVVSAHCADDAAAAGKAPGGGGGNSAKTPNQCKNKIESMKKRYRAESAAVARAGPAAAGPSWRFFARMDGLLKGPAVCSGQVQQAEFGNSIDLRAPAKAEAEVVVEADFASQLPDVGPGAFSDLMNIDTNGAVPEKAEKVDNSVQKESRAADSDANVSSPRSKVANEDVEEVDKVWDRPKKRKSTEFDIAKSIELLASSYLKIEHARMEMYRETERMRVEAEIKKGEMELKRTEIMAKTHLQIAKLFAKRLKEGSGKTGGSSSVTAHVDTHTKKGENGSG

SEQ ID NO: 4340 - protein, 344 aa, Panicum virgatum
  misc_feature (270)..(270): Xaa can be any naturally occurring amino acid
  misc_feature (343)..(343): Xaa can be any naturally occurring amino acid
APPQKRDEWSESGIVRLLEAYEAKWLLRNRAKLKWSDWVDIAREVSAHCADDAAAAGKPPGGGNSAKTPNQCKNKIESMKKRYRAESAAVARAGPAAAGPSWRFFARMDGLLKGPAVCSGQVQQSDLSNSIDLRAPAKAEAEVEADFVAQLTDAGPGAFSDLMNIDTNGAAPEKAEKVGNSVQKESRAADSDANVSSPRSKVANEDVEEVDRVSDRPKKRKSTEFDIAKSIELLASSYLKIEHARMDMYRETERMRVEAEIKKGEMELKXTEIMAKTHLQIAKLFAKRLKEGSGKTGGSSSVTAEVDTHTKKGENGSGLTQHPDNMFIILQKFLKLDRCVVFXL

SEQ ID NO: 4341 - protein, 308 aa, Zea mays
MTTTTTAAAAAVNVAAVAQLCAGPRRRKPAAGARVDLRWARLLRLAVVTRVLGVVRDQLLACSSCGGGGGGAARRRYLRLGPPAGANAGPVLSPVDRDDDCAADAEAAAPRDAADDVDNVVSLKVSLLGDCQIGKTSFMVKYVGDDGEDQNGLQMTGLNLMDKMMAVRGAKIAYSIWDVAGDHQSVDHIPIACKDAVAILYMFDLTSRCTLNNIVDWYERARKWNKTAIPILIGTKFDDFAQLPLEMQWTIVNQARAYARAMKATLFFSSATHNINVNKIFKFITAKLFDLPWTVERNLTIGEPIIDF

SEQ ID NO: 4342 - protein, 314 aa, Sorghum bicolor
MTTTTTTAPAATMNVTTVAQLCAGPRQRKPAAGARVDLRWARLLRLAVVTRVLRIVRDQLLACSSCGGGGGGGTAPPASDRNRHLGPPDDSPTLPPLDRYDHDCAADADADAEAAPRDAADDVDNVVSLKVSLLGDCQIGKTSFMVKYVGDDGEEQNGLQMTGLNLMDKTMAVRGARIAYSIWDVAGDHQSVDHIPIACKDAVAILYMFDLTSRCTLNNIVDWYERARKWNKTAIPILIGTKFDDFAQLPLEMQWAIVNQARAYARAMKATLFFSSATHNINVNKIFKFITAKLFNLPWTVERNLTIGEPIIDF

SEQ ID NO: 4343 - protein, 319 aa, Sorghum bicolor
MTTTTTTAPAATMNVTTVAQLCAGPRQRKPAAAAAAAGARVDLRWARLLRLAVVTRVLRIVRDQLLACSSCGGGGGGGTAPPASDRNRHLGPPDDSPTLPPLDRYDHDCAADADADAEAAPRDAADDVDNVVSLKVSLLGDCQIGKTSFMVKYVGDDGEEQNGLQMTGLNLMDKTMAVRGARIAYSIWDVAGDHQSVDHIPIACKDAVAILYMFDLTSRCTLNNIVDWYERARKWNKTAIPILIGTKFDDFAQLPLEMQWAIVNQARAYARAMKATLFFSSATHNINVNKIFKFITAKLFNLPWTVERNLTIGEPIIDF

SEQ ID NO: 4344 - protein, 313 aa, Setaria italica
MTTTTAAAAMNVAAVAQLCGGGGRRGRKAQGPRVDLRWARLLRLAVVSRVLRIVRDQLLACSSCGGGGGAGGGGGRGGGRYRRLGPPAHAGGAMLAPVHRGDECVPGAAGDAAPCDAAAADGENVVSLKVSLLGDCQIGKTSFMVKYVGDDGEEQNGLQMTGLNLMDKTMAVRGARIAYSIWDVAGDVQSVDHIPIACKDAVAILYMFDLTSRCTLNNIIDWYERARKWNKTAIPILIGTKFDDFAQLPLEMQWAIVNQARAYARAMKATLFFSSATHNINVNKIFKFITAKLFNLPWTVERNLTIGEPIIDF

SEQ ID NO: 4345 - protein, 310 aa, Pennisetum glaucum
MNVAAVAQLCGGRRGRKAQGGPRVDLRWARLLRLAVVSRVLRIVRDQLLACSSCGGGGGGGGGGGGAGGGGARGRGGRYRRLGPPPHAGAAVLVPVDRDDDCADGAAAPCDASAPADGGENVVSLKVSLLGDCHIGKTSFMVKYVGDDGEEQNGLQMTGLNLMDKTMAVRGARIAYSIWDVAGDVQSVDHIPIACKDAVAILYMFDLTSRCTLNNIIDWYERARKWNKTAIPILIGTKFDDFAQLPLEMQWAIVNQARAYARAMKATLFFSSATHNINVNKIFKFITAKLFNLPWTVERNLTIGEPIIDF

SEQ ID NO: 4346 - protein, 293 aa, Secale cereale
MTTTAAMNVAVTQLCGRGRRRRPAGLRLDLRWARLLRLAVATRVVRLVWDQLLACSSCGGGGAARYRRLGPPHGPDVLTPVAMDDDAGAAADAHADADAADVEDVVGLKVSLLGDCQIGKTSFMVKYVGDGEEQNGGLQMTGLNLMDKTLAVRGARLAFNIWDVAGDSQSADHVPIACKDAVAILFMFDLTSRCTLNNVTDWYERARKWNKTAIPILIGTKFDDFAQLPLEMQWTIVDEARAYARAMKATLFFSSATHNINVNKIFKFIMAKLFNLPWTVERNLTVGEPIIDF

SEQ ID NO: 4347 - protein, 292 aa, Triticum aestivum
MTTTAAAMNVAVTQLCGRGRRRRSAALRHDHRWARLLRLAVATRAVRLVWDQLLACSSCGGGGGARYRRLGPPHGPDVLTPVAMDDDAAAHAHADADAADVEDVVGLKVSLLGDCQIGKTSFMVKYVGDGEEQNGGLQMTGLNLMDKTLAVRGARLAFNIWDVAGDSQSADHVPIACKDAVAILFMFDLTSRCTLNNVTDWYERARKWNKTAIPILIGTKFDDFAQLPLEMQWTIVDEARAYARAMKATLFFSSATHNINVNKIFKFITAKLFNLPWTVERNLTVGEPIIDF

SEQ ID NO: 4348 - protein, 373 aa, Sorghum bicolor
MEMESTTLPLLTPYKMGEFNLAHRVVLAPLTRCRAYGNVPQPEHMAVYYCQRATPGGLLIAEACAVSESARGYPDVPGLWTDQQVEAWKPIVDAVHASGAVFFAQIWHTGRASAPEFQPNGQAPISSTDKQIPPQVSHAGVVNTFAVPRRPETEEIPHVVNDFRIAARNAIKAGFDGVEIHAANGYLFDQFMKDSTNDRDDAYGGSLENRCRFTAEVTAAVAAEVGGDRLGVRLSPFADYMDCHDSDPEALGLHVIDKTLNPLGVLYCHMVEARMRVNPEDGNKMTLQQMLLPFRRAFRVTFIASGGYDREEGNAAIAHGYADLIAYGRMFLANPDLPARFAKKAALNKYDRSTFYTSDPVVGYTDYPFLDQF

SEQ ID NO: 4349 - protein, 367 aa, Setaria italica
MESTPPLLTPYKMGEFNLAHRVVLAPLTRCRAYGNVPQPAHMSLYYCQRATPGGFLISEACAVSETARGYPDVPGLWTDEQVEAWKPIVDTVHAKGAVFFAQIWHTGRVSAPEFQPNGQAPISSTDKQVPPQVSQDGHVSTFAVPRRLETTEIPQVVNDFRIAARNAIKAGFDGVEIHAANGYLFDQFMKDSVNDRDDTYGGTLENRCRFTAEVVAAVAGEVGADRLGVRLSPFTDYMDCSDSDPEALALHVIRSTLNPLGVLYCHMLEPRMRVNPDDGKLTLPHMLLPFRKAFQGTFIVSGGYDQEEGNTAVTDGYGDLVAYGRLFLANPDLPARIARNAGLNNYDRSTFYTSDPVVGYTDYPFLD

SEQ ID NO: 4350 - protein, 217 aa, Sorghum bicolor
MARPGSSAAAPLLLLLAAAAASILAAAAASPAPSDFVRKSCRATQYPSVCEQSLASYGGSPAPRSPRELARAALSVSADRARAASAYVGRLCGGSSSSAGHKKGAAARKGGAPGSAAGPVRDCLENLADSVGHLRDAAQEMGGAGMSRSGTPAFKWHLSNVQTWCSAALTDENTCLDGLSSRGVDAGTRAAIRGKVVDVAQVTSNALALVNKVGPGY

SEQ ID NO: 4351 - protein, 214 aa, Zea mays
MARPRSVAAAAAAPLLLLLAAAAAGLVSAASPAASDFVRKSCRTTQYPSVCEQSLASYGGSPPPRSPRELARAALSVSADRARAASAYVGRLCGASNGKGAKKGSGSGSGSASAGPVRDCLDNLADSVGHLRDAAQEMGGAGMGRAGTPAFRWHLSNVQTWCSAALTDEDTCLDGLSSRAVDAGTRAAIRGKVVEVAQVTSNALALVNKVGPGY

SEQ ID NO: 4352 - protein, 165 aa, Unknown
  Sequence found in Organisms: Sorghum bicolor, Triticum aestivum
MASEHAAAGEGKHEKQSLMDKAKEFVADKIAHIPKPEATLDAVTFKGLSRECITLHSSVNVSNPYDHRLPICEVTYTLRCAGREVASGTMPDPGWIAASGTTSLEIPAKVPYDFIVSIVRDVGRDWDLDYELQVGLTVDLPIVGNFTIPLSTSGEFKLPTLKDLF

SEQ ID NO: 4353 - protein, 163 aa, Saccharum officinarum
MASEHAAGEGKQKQSLMDKAKEFVADKIAHIPKPEATLDAVTFKGLSRECITLHSTVNVSNPYDHRLPICEVTYTLKCAGREVASGTMPDPGWIAASGTTSLEIPAKVPYDFLVSLVRDVGRDWDLDYELQVGLTVDLPIVGNFTIPLSSSGEFKLPTLKDLF

SEQ ID NO: 4354 - protein, 163 aa, Panicum virgatum
MASEHAEAEPKQKQSLMDKAKEFVADKIAHIPKPEATLDGVSFKSMSRECITLHSNVNVSNPYDHRLPICEVTYTLKCAGKVVASGTVPDPGWIAASDTTKLEIPAKVPYDFLISLMKDVGRDWDIDYELQVGLTVDLPIIGNFTIPLSTSGEFKLPTLKDMF

SEQ ID NO: 4355 - protein, 161 aa, Panicum virgatum
MASEHAEPKQKQSLMDKAKEFVADKIVHIPKPEATLDGVSFKSMSRECITLHSNVNVSNPYDHRLPICEVTYTLKCAGKVVASGTMPDPGWIAASDTTKLEIPAKVPYDFLVSLMKDVGRDWDIDYELQVGLTVDLPIIGNFTIPLSTSGEFKLPTLEDMF

SEQ ID NO: 4356 - protein, 174 aa, Cenchrus ciliaris
MASEHAEPKQKQSLMDKAKEFVADKIAHIPKPEASLDSVSFKSMSRECITLHSNVNVSNPYDHRLPICEVTYTLKCAGKVVASGTMPDPGWIAANDSTKLEIPAKVPYDFLISIVKDVGRDWDIDYELQVGLTVDLPIIGNFTIPLSTSGEFKLPTIKDMLFGSSTTTESSEAT

SEQ ID NO: 4357 - protein, 163 aa, Cynodon dactylon
MASEAGEGEAKQKQSLMDKAKNFVAEKIAHIPKPKASLDGVSFKSMSRECITLHSNVNVNNPYDHRLPICDVTYTLKCAGKVVASGTLPDPGWIAASGDTKLEIPAKVPYDFLISIIKDVGRDWDVDYVLDVGLTIDLPIVGNFTIPLSTSGEFKLPTLKDMF

SEQ ID NO: 4358 - protein, 124 aa, Pennisetum glaucum
MSRECITLHNPYDHRLPICEVTYTLKCAGKVVASGTMPDPGWIAASDSTKLEIPAKVPYDFLISIVKDVGRDWDIDYELQVGLTIDLPIVGNFTIPLSTSGEFKLPTIKDMLFGGSTTSESEAK

SEQ ID NO: 4359 - protein, 170 aa, Setaria italica
MASEHAEPKQKQSLMDKAKEFVVDKIAHIPKPEASLDSVSFKSMSRECITLHSNVNISNPYDHRLPICEVTYTLKCAGKVVASGTMPDPGWIAASDSTKLEIPAKVPYDFLISIVKDVGRDWDIDYELQVGLTIDLPIVGKFTIPLSTSGEFKLPTIKDMLFSRTPSEAS

SEQ ID NO: 4360 - protein, 506 aa, Sorghum bicolor
MTIDMSMPGSSGLLNAAGKRDMKFFSNPYVLALTGAAGIGGFLFGYDTGVISGALLYIRDDFPAVRDNYFLQETIVSMALVGAMLGAAGGGWINDAYGRKKSTLLADMMFALGSLVMCAAAGPYILIIGRLLVGLGVGVASVTAPVYIAEAAPSEIRGGLVSTNVLMITGGQFFSYLINLGFTEVPGTWRWMLGVAAVPAIVQFVLMLFLPESPRWLYWKDEKAKAIAVLEKIYDSDRLEEEVELLASSSMHEFQSNNAGSYLDVFKSKELRLAFFAGAGLQAFQQFTGINTVMYYSPTIVQMAGFSSNRLALLLSLIVAAMNAAGTIVGIYLIDRCGRRRLALTSLSGVVISLVILALAFILQSSSGLCMSAANGTCQGVLGWFAVAGLALYIAFFSPGMGPVPWAVNSEIYPEAYRGMCGGMSATVNWISNLIVAQTFLSIVGLVGTGPTFLIIAGIAVLAFIFVAMYVPETKGLSFEQVEQMWKERAWGNSGNCQRLLGAAAP

SEQ ID NO: 4361 - protein, 505 aa, Pennisetum glaucum
MTIDMSMPGSSGLLDAAGKRNMKFFSNRYVLALTGAAGIGGFLFGYDTGVISGALLYIRDEFPAVRDNYLLQETIVSMALVGAMLGAAGGGWMNDAYGRKKSTLLADLMFALGSIVMCAAGGPYILILGRLLVGLGVGVASVTAPVYIAEAAPSEIRGGLVSTNVLMITGGQFFSYLINLGFTEVPGTWRWMLGVAAVPAIVQFVLMLFLPESPRWLYWKDEKAQAIAVLEKIYDPDRLEEEVELLASSSMHEFQSDNTASYLDVFKSKELRLAFFAGAGLQAFQQFTGINTVMYYSPTIVQMAGFTSNKLALLLSLIVAAMNAAGTIVGIYLIDRCGRRRLALTSLSGVVISLVILAMAFILQSSSNLCMAAANGTCQGILGWLAVAGLALYIAAFSPGMGPVPWAVNSEIYPEAYRGMCGGMSATVNWISNLIVAQTFLSIVGLVGTGVTFLIIAGIGVLAFIFVALYVPETKGLSFEQVEQLWKERAWGSRGDCQSLLGAAP

SEQ ID NO: 4362 - protein, 505 aa, Setaria italica
MTIDMSMPGSSGLLNAAGKRNMKFFSNSYVLALTGAAGIGGFLFGYDTGVISGALLYIRDEFPAVRDNYFLQETIVSLALVGAMLGAAGGGWINDAYGRKKSTLLADLMFALGSIVMCAAPGPYVLILGRLFVGLGVGIASVTAPVYIAEAAPSEIRGGLVSTNVLMITGGQFFSYLINLGFTEVPGTWRWMLGVAAVPAIVQFVLMLFLPESPRWLYWKDKKAQAIAVLEKIYDSDRLEEELELLASSSMHEFQSDNTASYLDVFKSKELRLAFFAGAGFQAFQQFTGINTVMYYSPTIVQMAGFTSNKLALLLSLIVAAMNAAGTIVGIYLIDRCGRRRLALTSLSGVVISLVILAMAFILQSSSSLCMAAANGTCQGILGWFAVAGLALYIAAFSPGMGPVPWAVNSEIYPEAYRGMCGGMSATVNWISNLIVAQTFLSIVGLVGTGVTFLIIAGIGVLAFIFVALYVPETKGLSFEQVEQLWKERAWGSHGDCQSLLGAAP

SEQ ID NO: 4363 - protein, 506 aa, Oryza sativa
MTIDLSMPGSSGLLDDVGGKKHMNFFSNRYVLALTGAAGIGGFLFGYDTGVISGALLYIRDDFPAVRDNYFLQETIVSMALVGAIIGAAGGGWINDTYGRRKSTLVADMLFALGSLVMCAAGGPYILILGRLLVGLGVGIASVTAPVYIAEAAPSEIRGGLVSTNVLMITGGQFFSYLINLGFTEVPGTWRWMLGVAAVPAILQFVLMLFLPESPRWLFWKDEKAKAISVLEKIYDSDRLEEEVELLASSSMHEFQSDGTGSYLDIFKSKELRLAFFAGAGLQAFQQFTGINTVMYYSPTIVQMAGFTSNKLALLLSLIVAGMNAAGTIVGIYLIDRCGRRRLALTSLAGVVVSLAILAMAFILQSSSDICSNALNGACQGALGWFAVAGLALYIAFFSPGMGPVPWAVNSEIYPEAYRGMCGGMSATVNWVSNLIVAQTFLSIVGLVGTGLTFLIIAGIAVLAFIFVALYVPETKGLSFEQVELLWKERAWGNQGNRQSLLGAAP

SEQ ID NO: 4364 - protein, 506 aa, Brachypodium distachyon
MTIDLSTMPGSSGLLDTAGRRDMNFFRNRYVLGLTGVAGIGGFLFGYDTGVISGALLYIRDEFPAVKDNLFLQETIVSMALLGAMLGAAGGGWINDVYGRKKSTLLADMMFALGSLVMCAAGGPYILILGRLFVGLGVGIASVTAPVYIAEAAPSEIRGGLVSTNVLMITGGQFFSYLVNLGFTEVPGTWRWMLGVAAVPACIQFVLMLFLPESPRWLYRKDEKAKAIAVLEQIYDSDRLEEEVEMLASSSMHEFQSNCTGSYLDIFKSKELRLAFFAGAGLQAFQQFTGINTVMYYSPTIVQMAGFTSNRLALLLSLIIAAMNASGTIVGIYLIDRCGRRRLALTSLAGVVISLVILAMAFILQSSSILCESMFLGSCQGMLGWFAVAGLALYIAFFSPGMGPVPWAVNSEIYPEAYRGMCGGMSATVNWISNLIVAQTFLSIVGWVGTGPTFLIIAGIAVLAFIFVALYVPETKGLSFEQVELMWKERAWGNQGDRESLLGAAP

SEQ ID NO: 4365 - protein, 509 aa, Triticum aestivum
MTIDLSTMPGSSSSRLLDAAAGRKDMNFFKNRYVLGLTGVAGIGGFLFGYDTGVISGALLYIRDEFPAVKDNLFLQETIVSMALLGAILGAAGGGWINDAYGRKKSTLLADLMFALGSLVMCAAGGPYVLILGRLFVGLGVGIASVTAPVYIAEAAPSEIRGGLVSTNVLMITGGQFFSYLVNLGFTEVPGTWRWMLGVAAVPAIIQFVLMLFLPESPRWLYRKDEKAKAIAVLEQIYDSGRLEEEVELLASASMHEFQSNCTGSYLDIFRLKELRLAFFAGAGLQAFQQFTGINTVMYYSPTIVQMAGFTSNRLALLLSLVVAAMNASGTIVGIYLIDRCGRRRLALTSLAGVVLSLVILATAFILQSSSSLCGSLFSGSCQGVLGWFAVGGLALYIAFFSPGMGPVPWAVNSEIYPEAYRGMCGGMSATVNWISNLIVAQTFLSIVGWVGTGPTFLIIAGIAVLAFIFVALYVPETKGLSFEEVDLLWKERAWGSQGSHESLLGAAP

SEQ ID NO: 4366 - protein, 509 aa, Triticum aestivum
MTIDLSTMPGSSSSRLLDAAAGRKDMNFFRNRYVLGLTGVAGIGGFLFGYDTGVISGALLYIRDEFPAVKDNLFLQETIVSMALLGAILGAAGGGWINDAYGRKKSTLLADLMFALGSLVMCAAGGPYVLILGRLFVGLGVGIASVTAPVYIAEAAPSEIRGGLVSTNVLMITGGQFFSYLVNLGFTEVPGTWRWMLGVAAVPAIIQFVLMLFLPESPRWLYRKDEKAKAIAVLEQIYDSGRLEEEVELLASASMHEFQSNCTGSYLDIFRLKELRLAFFAGAGLQAFQQFTGINTVMYYSPTIVQMAGFTSNRLALLLSLIVAAMNASGTIVGIYLIDRCGRRRLALTSLAGVVLSLVILATAFILQSSSSLCGSLFSGSCQGVLGWFAVGGLALYIAFFSPGMGPVPWAVNSEIYPEAYRGMCGGMSATVNWISNLIVAQTFLSIVGWVGTGPTFLIIAGIAVMAFIFVALYVPETKGLSFEEVDLLWKERAWGGQGSHESLLGSAP

SEQ ID NO: 4367 - protein, 325 aa, Triticum aestivum
MTIDLSTMPGSSSSRLLDAAAARKDMNFFKNRYVLGLTGVAGIGGFLFGYDTGVISGALLYIRDEFPAVKDNLFLQETIVSMALLGAMLGAAGGGWINDAYGRKKSTLLADLMFALGSLVMCAAGGPYILILGRLFVGLGVGIASVTAPVYIAEAAPSEIRGGLVSTNVLMITGGQFFSYLVNLGFTEVPGTWRWMLGVAAVPAIIQFVLMLFLPESPRWLYRKDEKAKAIAVLEQIYDSGRLEEEVELLASASMHEFQSNCTGSYLDIFRLKELRLAFLLELVFRPFSNLLASTPSCTTAPRSSRWLGSLPTGWPCYFPSSLPP

SEQ ID NO: 4368 - protein, 508 aa, Hordeum vulgare
MTIDLSTMPGSSARLLDAAAGRKDMNFFTNRYVLGLTGVAGIGGFLFGYDTGVISGALLYIRDEFPAVKDNLFLQETIVSMALLGAILGAAGGGWINDAYGRKKSTLLADLMFALGSLVMSAAGGPYILILGRLFVGLGVGIASVTAPVYIAEAAPSEIRGGLVSTNVLMITGGQFFSYLVNLCFTEVPGTWRWMLGVAAVPAIIQFVLMLFLPESPRWLYRKDEKAKAIAVMEQIYDSGRLEEEVDLLASASMHEFQSNCTGSYLDIFRLKELRLAFFAGAGLQAFQQFTGINTVMYYSPTIVQMAGFTSNRLALLLSLIVAAMNASGTIVGIYLIDRCGRRRLALTSLAGVVLSLVILATAFILQSSSSLCGSLFSGSCQGVLGWFAVGGLALYIAFFSPGMGPVPWAVNSEIYPEAYRGMCGGMSATVNWISNLIVAQTFLSIVGWVGTGPTFLIIAGIAVMAFIFVALYVPETKGLSFEEVDLLWKERAWGNQGSHESLLGAAR

SEQ ID NO: 4369 - protein, 484 aa, Setaria italica
MKFFSNSYVLALTGAAGIGGFLFGYDTGVISGALLYIRDEFPAVRDNYFLQETIVSLALVGAMLGAAGGGWINDAYGRKKSTLLADLMFALGSIVMCAAPGPYVLILGRLFVGLGVGIASVTAPVYIAEAAPSEIRGGLVSTNVLMITGGQFFSYLINLGFTEVPGTWRWMLGVAAVPAIVQFVLMLFLPESPRWLYWKDKKAQAIAVLEKIYDSDRLEEELELLASSSMHEFQSDNTASYLDVFKSKELRLAFFAGAGFQAFQQFTGINTVMYYSPTIVQMAGFTSNKLALLLSLIVAAMNAAGTIVGIYLIDRCGRRRLALTSLSGVVISLVILAMAFILQSSSSLCMAAANGTCQGILGWFAVAGLALYIAAFSPGMGPVPWAVNSEIYPEAYRGMCGGMSATVNWISNLIVAQTFLSIVGLVGTGVTFLIIAGIGVLAFIFVALYVPETKGLSFEQVEQLWKERAWGSHGDCQSLLGAAP

SEQ ID NO: 4370 - protein, 505 aa, Secale cereale
MTIDLSTMPGSSARLLDAAAGRKDMNFFKNRYVLGLTGVAGIGGFLFGYDTGVISGALLYIRDEFPAVKDNLFLQETIVSMALLGAMLGAAGGGWINDAYGRKKSTLLADLMFALGSLVMSAAGGPYILILGRLFVGLGVGIASVTAPVYIAEAAPSEIRGGLVSTNVLMITGGQFFSYLVNLGFTGVPGTWRWMLGVAAVPAIIQFVLMLFLPESPRWLYRKDEKAKAIAVLEQIYDSGRLEEEVDLLASASMHEFQSNCTGSYLDIFRLKELRLAFYAGAGLQAFQQFTGINTVMYYSPTIVQMAGFTSNRLALLLSLVVAAMNASGTIVGIYLIDRCGRRRLALTSLAGVVLSLVILATAFILQSSSSLCGSLSCQGALGWFAVGGLALYIAFFSPGMGPVPWAVNSEIYPEAYRGMCGGMSATVNWISNLIVAQTFLSLVGWVGTGPTFLIIAGIAVMAFIFVALYVPETKGLSFEEVDLLWKERAWGSQGSHESLLGAAP

SEQ ID NO: 4371 - protein, 530 aa, Brachypodium distachyon
MTIDLSTMPGSSGLLDTAGRRDMNFFRNRYVLGLTGVAGIGGFLFGYDTGVISGALLYIRDEFPAVKDNLFLQETIVSMALLGAMLGAAGGGWINDVYGRKKSTLLADMMFALGSLVMCAAGGPYILILGRLFVGLGVGIASVTAPVYIAEAAPSEIRGGLVSTNVLMITGGQFFSYLVNLGFTEKNHVKSSVCYVVLKMNSLEKAFSMVPGTWRWMLGVAAVPACIQFVLMLFLPESPRWLYRKDEKAKAIAVLEQIYDSDRLEEEVEMLASSSMHEFQSNCTGSYLDIFKSKELRLAFFAGAGLQAFQQFTGINTVMYYSPTIVQMAGFTSNRLALLLSLIIAAMNASGTIVGIYLIDRCGRRRLALTSLAGVVISLVILAMAFILQSSSILCESMFLGSCQGMLGWFAVAGLALYIAFFSPGMGPVPWAVNSEIYPEAYRGMCGGMSATVNWISNLIVAQTFLSIVGWVGTGPTFLIIAGIAVLAFIFVALYVPETKGLSFEQVELMWKERAWGNQGDRESLLGAAP

SEQ ID NO: 4372 - protein, 209 aa, Sorghum bicolor
MRRGYSYSPSPPRGYRRRERSPSPRDYYGGRGRDLPTSLLVRNLRRDCRPEDLRRPFGQFGRLKDIYLPRDYYTGEPRGFGFVQYYDPDDAADAKYYMDGQVVLGRQITVVFAEENRKKPQEMRARDRVRGHSYDRRYSRSRSPRYYRGGSPSRSRSYSRSPSPRDPKHRLRERSYSGSPVDSISRSGSPYEDGYPRSSQRERSVSVSG

SEQ ID NO: 4373 - protein, 207 aa, Panicum virgatum
MRRGYSYSPSPPRGYGRRARSPSPRDHYGGRGRDLPTSLLVRNLRRDCRPEDLRRPFGQFGRLKDIYLPRDYYTGEPRGFGFVQYYDPEDAADAKYYMDGQLVLGRQITVVFAEENRKKPQEMRVRDRVRGRSYDRRYSRSRSPLYSRGRSPSRSYSRSPSPPNPKHRLRERSYSRSPVDSRSRSGSPYEEQYRRSSRRERSLCVAG

SEQ ID NO: 4374 - protein, 207 aa, Panicum virgatum
MRRGYSYSPSPPRGYRRRARSPSPRDHYGGRGRDLPTSLLVRNLRRDCRPEDLRRPFGQFGRLEDIYLPRDYYTGEPRGFGFIQYYDPEDAADAKYYMDGQLVLGRQITVVFAEENRKKPQEMRARDRVRGRSYDRRYSRSRSPLYSRGRSPSRSYSRSLSPPNPKHRLRERSYSRSPVDSRSRSGSPYEEEYRRSSRRERSLSATG

SEQ ID NO: 4375 - protein, 207 aa, Setaria italica
MRRGYSYSPSPPRGYRRRARSPTPRDYNGDRGRDLPTSLLVRNLRRDCRPEDLRRPFAQFGRVKDIYLPRDYYTGEPRGFGFVQFYDPEDAADAKYYMDGQIVLGRQITVVFAEENRKKPQEMRARDRVRGRSYDRRYSRSRSPPYSRGRSPSRSYSRSPSPPNPKHRLRERSYSRSPVDSRSRSGSPYEERYRRSSPRERSLPVSG

SEQ ID NO: 4376 - protein, 207 aa, Cenchrus ciliaris
  misc_feature (95)..(95): Xaa can be any naturally occurring amino acid
MRRGYSYSPSPPRGYRRRDRSPSPRDHYGGRGRDLPTSLLVRNLRRDCRPEDLRRPFAQFGRLKDIYLPRDYYTGEPRGFGFVQYYDPEDAADAXYYMDGQMVLGRQITVVFAEENRKRPQEMRARDRVRGRSYDRRYSRSRSPPYSRGRSPSRSYSRSPSPPLPRRRLRERSYSRSPVDSRSRSGSPYGERYYRSSRRERSLSVSG

SEQ ID NO: 4377 - protein, 208 aa, Pennisetum glaucum
MRRGYSYSPSPPRGYRRRDRSPSPRDHYGGRGRDLPTSLLVRNLRKDCRPEDLRRPFAQFGRLKDIYLPRDYYTGEPRGFGFVQYYDPEDAADAKYYMDGQMVLGRQITVVFAEENRKKPQEMRARDRVRGRSYDQRYSRSRSPLYSRGRSPPSRSYSRSPSPRDPKHRLRERSYSRSPIDSRSRSGSPYEERYHRSSRRERSLSVSG

SEQ ID NO: 4378 - protein, 132 aa, Sorghum bicolor
MAAPQSSTGSLVPPLRRRPRRLVFDRRYGWIFDEWTDPADQALSGGRGMFCAVTMARSLVDAAASSINYAASSISRVLEHPKRLRKKQQAWFRELECSGVVADLKLVHCCTHSVLECTATDCLCLTKKHGHL

SEQ ID NO: 4379 - protein, 150 aa, Sorghum bicolor
MEARRSSAALVGVAVVALLVVLVPETSRAERFVVGDAARWTWGYNYTDWVIKKGPFFQNDTLVFMYDPPNATVHAHSVYLMRNAADYQSCNLKAAKLVANVMQGAGSGFEFVLKKRKQHYFVCGERGGIHCTMGNMKFVVKPKSSACRDD

SEQ ID NO: 4380 - protein, 150 aa, Saccharum officinarum
MEARRRSAALVGVAVAALLVVLVPETSRAERFIVGDAARWTWGYNYTDWVIRKGPFFQNDTLVFMYDPPNATVHAHSVYLMRNAADYQSCNLKAAKLVANVMQGAGSGFEFVLKKRKQHYFVCGERGGIHCTMGNMKFVVKPKSSACRDD

SEQ ID NO: 4381 - protein, 152 aa, Setaria italica
MAEARSGAALVAAAAVVALLVLALAPEGSRAERFIVGDAARWTWGYNYTDWVIKKGPFFQNDTLVFMYDPPNATVHAHSVYMMRNAADYQSCNLKAAKLVAGVTQGAGSGFEFVLTKRKKHYFVCGERGGIHCTMGQMKFIVKPKSSACRDD

SEQ ID NO: 4382 - protein, 152 aa, Pennisetum glaucum
MAAARSGAALVAVAAGVALLVLALAPEASRAERFVVGDAARWTWGYNYTDWVIKKGPFFQNDTLVFMYDPPNATVHAHSVYMMRNAADYQSCNLKAAKLVAGVTQGSGAGFEFVLRKRKKHYFVCGERGGIHCTMGQMKFIVKPKSSVCRDD

SEQ ID NO: 4383 - protein, 149 aa, Oryza sativa
MEGRISSATLVVAAVLAMLVLVPAAARAERFVVGDAARWTWGYNYTDWVIKKGPFFQNDSLVFMYDPPNATTHAHSVYMMRNAADYQSCNLKAAKLVANVMQGAGSGYEFVLRKRKPHYFVCGERGGIHCTMGQMKFIVKPKSSACRDD

SEQ ID NO: 4384 - protein, 142 aa, Setaria italica
VAAAAVVALLVLALAPEGSRAERFIVGDAARWTWGYNYTDWVIKKGPFFQNDTLVFMYDPPNATVHAHSVYMMRNAADYQSCNLKAAKLVAGVTQGAGSGFEFVLTKRKKHYFVCGERGGIHCTMGQMKFIVKPKSSACRDD

SEQ ID NO: 4385 - protein, 598 aa, Setaria italica
MVFDAGAGSSPAAAAPSGNPLRVILTRGFARQVLVGRWFTVFASLLIMAASGATYIFGSYSGTLKSSLEYDQHTLNTVSFFKDLGANLGVFSGLINEVTPPWVVLAMGATMNLSGYLMVYLAVSGRTARPPVWLVCLYFFIGANSQSFANTGALVTCVKNFPESRGVVLGILKGFVGLSGAVYTQLYLAFYGGDDAESLILLIAWLPAAVSVVFVHTIRYMPYPRRRGGQETSPDPFFCFLYLSIALASFLLVMIVVQKQVPFSREAYGLAATPLLILLLMPLGVVVKQEYKIFRERQLDAALLAAGPPPTITVAGAANDNIQMSTDTKKTEQQQPAPPTSTSSSCLGRFGGCVRTMFRPPARGEDYTILQALVSVDMLVLFVASICGVGGTLTAIDNMGQIGQSLGYPSKSINTFVSLISIWNYAGRVTARVRLGGRPRPLPLPAPPPPHARPPPRLRRPPPDRLRRPPVPLRRLRDHRVLLRRAVAAGVRRHLRDLRAQVLLHALQLRRHGEPRGVLHPQRARRGAALRRRGRAAGERRWRRRGGDEAREGVPRGGVLQEVVPDHHGGDGGRRGGVAGAGVADLGVLQGGHLREVS

SEQ ID NO: 4386 - protein, 625 aa, Zea mays
MVFAASGGSSPATAAPGSALGVILTRGFARQVLVGRWFTVLASLLIMASSGATYVFGSYSGALKSSLGYDQRTLNTVSFFKDLGANLGVLPGLLNEVTPPWVVLATGAGMNLFGYLMVYLAVSGRTARPPPWAVCAYFFVGANSQAFANTGALVTCVNNFPETRGVVLGILKGFVGLSGAVYAQLYQALYGGEDAESLILLVAWLPAAVSVAFVHTIRYMPYPRRRRSGGGGGQETSSDPFFCFLYLSIALACFLLVMIVVQGQVPFSRAAYGVAAAPLLILLLMPLGVVVKQEYKIYRERQLDAAADPPPTIAVVDAGAPPVPSSVQMSSAAATAAVEETEQQQQAATSSASSSCCLGSLGGWGVRTMFRPPARGEDYTILQALVSVDMLVLFVATTCGMGGTLTAIDNMGQIGKSLGYPAKSVNTFVSLISIWNYAGRVAAGYVSEAALARHRVPRPLLLTGVLLLACAGHALIALGAPRSLYAASVVVGFCFGAQWPLVFAIVSELFGLRRFSTLHNLGGLASPVGSYILNVRVAGRLYDAAAARQRGGSGRVCLGVECYRRSFLIITAATAAGALVSLVLVWRTWRFYRGDIYARFRDGDGRLPVDRQQEEREKATAANGR

SEQ ID NO: 4387 - protein, 661 aa, Sorghum bicolor
MVFDASGSSSPATAPPPSGNPLGVILTRRFARQVLLGRWFTVFASLLIMAASGATYIFGSYSGTLKSSLGYDQRTLNTVSFFKDLGANLGVFSGLINEVTPPWVVLAMGAGMNLFGYLMVYLAVSGRTSRPPLWLVCLYFFVGSNSQSFANTGALVTCVKNFPESRGVVLGILKGFVGLSGAVYTQLYQALYGGDDAESLILLIAWLPAAVSVVFVHTIRYMPYPPRRRRRRGGGGGGGQETSSDPFFCFLYLSIALACFLLVMIVVQHQVPFSRDAFGVAATPLLILLLMPLCVVVKQEYKIYRERQLDAADPTPPTITVDDGGAGTAPPPPPPSSSSSVLQMSAAATDDTTTTTTKKTEQPSSSSSCLGSLGKCVRTMFRPPPRGEDYTILQALVSVDMLVLFVATICGVGGTLTAIDNMGQIGESLGYPSKSINTFVSLISIWNYAGRVTAGYASEAVLVRYRVPRPVLLTAVLLLACAGHVVIALGVGNGLYAASVVIGFCFGAQWPLVFAIISEVFGLKYYSTLYNFGGMASPVGSYILNVRVAGRLYDAAAARQRNGAGGGGKHDKLCLGVECYKRSFLIITAATVAGAAVSLVLVWRTWRFYRGDIYARFRDGDGGEGEGTGKDGRLPVDRRGVGEEEEEEEEEREKAANGRKG

SEQ ID NO: 4388 - protein, 510 aa, Sorghum bicolor
MEPRRRRPPRLPLHVLFLVAAAWPLGSSGTGSFGVGAESNGASSSFRNSRRLQQIGDRNEDGLFHLPHPRTLTHKSRSHRRVPAPAPAPASAPAPSPSMSSPEGSPSPSPHGSQSMPRQSTSHRHPSVAPPHLVRPEPRQDENDPIVDTPPHSRHKNSWTTYGLVAAGIAVFLLVSAASILCFRAKKMGTVRPWATGLSGQLQKAFVTGVPSLKRSELETACEDFSNIIGSTSTCMLYKGTLSSGVEIAVASSLVTSAKDWSKENESQYRKKITSLSKVSHKNFMNLLGYCEEEHPFTRVMVFEYAPNGTLFEHLHVREAEKLDWMARLRISMGIAYCLEHMHQLKTPLVLRNFDSTTVYLTDDFAAKVSDLEFWNDAKGYNSTNNELAFSLDLENIVHKYGMVLLEILTGKVPCSEDDGPLENWASRYFEGEMRLEELIDSSIGFFPEDTARALCEVVRSCIDRDPKKRPQMQEVAARMREITALGPDGATPKVSPLWWAELEIMSSES

SEQ ID NO: 4389 - protein, 69 aa, Sorghum bicolor
MTRGDQRERDRQRAQARRPAAKGRDDGLTPEQRRERDAKALQEKAARKAAQAAGGGADAKGGKNAKGKK

SEQ ID NO: 4390 - protein, 94 aa, Sorghum bicolor
FLALLPEASSPHHSPLSQSARVPVSLPPFLPTQLRSQHNDSYPWPHMIFLSPSVFFFSCRSIDSCRGFSFRLCQILFPFDIFCCKVEVEPVCFG

SEQ ID NO: 4391 - protein, 101 aa, Sorghum bicolor
ARLPASRFLALLPEASSPHHSPLSQSARVPVSLPPFLPTQLRSQHNDSYPWPHMIFLSPSVFFFSCRSIDSCRGFSFRLCQILFPFDIFCCKVEVEPVCFG

SEQ ID NO: 4392 - protein, 67 aa, Panicum virgatum
MTRGDQRERDRQRAQARRPVAKGRDDGLTPEQRRERDAKALQEKAARKAAQAAGGGDAKGAGKNAGK

SEQ ID NO: 4393 - protein, 461 aa, Setaria italica
MGYGMSRLEDEYYEPEGQDADGSSSDQVNDEFSKLHNDIFHMTRMRSGLSESIYKSVGANRGIISTAKLLSGREVDCSGKGKFSSGDRAFVLGRYVPMNGPELLDRMDSRAYVSQFSADGTLFVAGFQGSHIRIYDVDRDWRIHKDIHARNLRWTISDVSLSPDQRYLVYSSLAPIIHIVNVGNAARESYANVTDIHDGLDFSQHEDVQYSFGIFSVKFSSDGRELVAGSNDESIYVYDLHANKLTLRLPAHTSDVNTVAFADESGHLIYSGSDDTLCKVWDRRCLSAGQAAGVLSGHLHGVTHIDSRGDGRSFISNGKDQAIKLWDIRKMMSNADSCADDAPTWDYRLSRYPQQNKQLKHPHDQSLATYRGHSVLRTLIRCYFSPAYSTGQKYIYTGSYDSSIYIYDVVSGSQVAKLKGHQTAIRDCSWHPFEPTLVSSSWDGRVAKWTGARDEKSSDVD

SEQ ID NO: 4394 - protein, 69 aa, Saccharum officinarum
RGDQRERDRQRAQARRPVAKGRDDGLTPEQRRERDAKALQEKAARKAAQAAGGGGGGADAKGGKNAGKK

SEQ ID NO: 4395 - protein, 71 aa, Setaria italica
MTRGDQRERDRQRAQARRPVAKGRDDGLTPEQRRERDAKALQEKAARKAAQAAGGADAKGGKGAGKNGVKK

SEQ ID NO: 4396 - protein, 67 aa, Triticum aestivum
MTRGDQRERDRQRAQARKPGAKGRDDGLTPEQRRERDAKALQEKTAKKAAQATQGADDAKKNAAGKK

SEQ ID NO: 4397 - protein, 463 aa, Oryza sativa
MGYGMSRMEEEYSEHEDQNNGGSNSQVNNEFLNTHNDIFHMTQIRSGPSESLRKSIGTSKDVISTTRLLSGREINSSGNGKFSSVDRAFLLGRYLPVDGPEIVDRMDSRAYVSQFSADGSLFVAGFQGSHIRIYDVDKGWKVHRDIHARSLRWTISDASLSPDQQFLVYSSLAPIIHIVNVGTAAKQSYANITDIHDGLDFSQHEDVRYTFGIFSVKFSSDGRELVAGSNDDSIYVYDLVANKLTLRLPAHHSDVNTVAFADETGHLIYSGSDDNLCKVWDRRCLSTEEPAGVLTGHLHGITHIDSRGDGRCFISNGKDQAIKMWDIRKMTSNADSYEDRTSNWDYRYSRYPQQYKQLKHPHDQSIATYWGHSVLRTLIRCYFSPAYSTGQKYIYTGSYDSSVCIYDVVSGSQVAKLKGYHQLAIRDCSWHPFDPMLVSSSWDGRVAKWSRSSCQQEETTDLD

SEQ ID NO: 4398 - protein, 67 aa, Hordeum vulgare
MTRGDQRERDRQRAQARKPGSKGRDDGLTPEQRRERDAKALQEKTAKKAAQATKGADDAKKNAAGKK

SEQ ID NO: 4399 - protein, 68 aa, Secale cereale
MTRGDQRERDRQRAQARKPGAKGRDDGLTPEQRRERDAKALQEKTAKKAAQATQGADDAKKKNAAGKK

SEQ ID NO: 4400 - protein, 68 aa, Brachypodium distachyon
MTRGDQRERDRQRAQARKPSTKGKDDGLTPEQRRERDAKALQEKTAKKAAQAAQGAAADAKKKNAGKK

SEQ ID NO: 4401 - protein, 463 aa, Brachypodium distachyon
MGYGMSRLEDEYSEHEGQSSDGLSSAQMNNEFSKLHNDIFHMTHLRSGPSESIRKSIGINKHAVSVTRLLRGREVNSSGTGKFFSVDRAFILGHYLPVDGPEIVDRMNSRAYVSQFSADGSLFVAGFQGSHIRIYDVDKGWEVHKDIHARSLRWTISDVSLSPDQRFLVYASLAPIIHIVNVGTASKESYANVTDIHDGLDFSQHEDVRYSFGLFSVKFSTDGRELVAGSNDDSIYVYDLQADKLTLRLPAHTSDVNTVAFADETGNLIYSGSDDNLCKVWDRRCLSTGEPAGVLTGHLHGITHIDSRGDGRCFISNGKDQAIKMWDIRKMTSNADGSENRVPAWDYTNSRYPQQYKQQKHPHDQSLATYRGHSVLRTLIRCYFSPTYSTGQKYIYTGSYDASICIYDVVSGSQVAKLHKGHELAVRDCSWHPFDPMLVSSSWDGRIAKWSRTCSEQDTCELD

SEQ ID NO: 4402 - protein, 66 aa, Avena sativa
MTRGDQRERDRQRAQARKPGSKGRDDGLTPEQRRERDAKALQEKTAKKAAQAGAAADAKKKDAGKK

SEQ ID NO: 4403 - protein, 110 aa, Saccharum officinarum
MPETTKLILLSRAWAAASLILLLLLVLHGRGGHCIGLGMEAELEMDSEAHRRLLWEATTGQRYISYAALRGDVVPCSRTGVPYYNCRISTTANPYTRGCESITRCRDADP

SEQ ID NO: 4404 - protein, 110 aa, Panicum virgatum
MPATTKLILLFRAWAAASLLLILVLALHGRGGHCGGLSLDAEMEMDSEAHRRLLWEATTGRRYISYDALRGDVVPCSRTGVPYYNCRISTTANPYTRGCESITRCRDAGP

SEQ ID NO: 4405 - protein, 111 aa, Setaria italica
MPATTKLISLSRAWATASLLLMLVLALHGRGGHCVGLGMDAAEMEMDSEAHRRLLWEATGGRRYISYDALRGDVVPCSRTGVPYYNCRVSTTANPYTRGCESITRCRDAGP

SEQ ID NO: 4406 - protein, 145 aa, Panicum virgatum
KPSSPSIKIKKTAKIQCRERERDSEQNRDLSQSPPMPATTKLILLFRAWAAASLLLILVLALHGRGGHCGGLSLDAEMEMDSEAHRQLLWEATTSRRYISYDALRGDVVPCSRTGVPYYNCRISTTANPYTRGCESITRCRDAGP

SEQ ID NO: 4407 - protein, 374 aa, Saccharum officinarum
MESSLLDTAVAAGLCPAAAGRRRAGSTASFLSCSCSSRDCRVSASYSHSISRMLSGVRSAARKKLFRTDPAAADLLGIANWSDETSGGAGGHQQQQHWWTALENNFVLEATDDEYGGVVVDADRLPDDKAAFARSLAASLSYWKSVGKKGVWLKLPVDRAEFVPLAVKEGFKYHHAEEAYLMMTYWIPDDEPNMLPANASHQVGVGGFVINDQMEVLVVQEKYRGSSLDGVWKLPTGFILASEEIYTGASREVKEETGVDTEFVDVVAFRHAHNVAFQKSDLFFICMLRPVSSEIKIDETEIQAAKWMALEEFVKQPFIQEDHMFQKIMDICIQRLRKCYCGLMPHHVVSKFDDRTSTLYYNVAEPEDVNCSAA

SEQ ID NO: 4408 - protein, 367 aa, Setaria italica
MESSLLDTAVAAASLYPAAARRRRAGSTASFLSCSSCSSRDCRVSASYSHSISRMLSGVRSAARKKLFRADPADLLGVANWPETGGGHQQHWWTALEHNFVLEATDDEYGGVVVDADRLPADKAAFARSLAASLSYWKSVGKKGVWLKLPVDLAEFVPLAVKEGFKYHHAEESYLMMTYWIPDEPNMLPANASHQVGVGGFVINDQMEVLVVQEKYHGSSLDGVWKLPTGFILASEEIYTGASREVKEETGVDTEFVDVVAFRHAHNVAFQKSDLFFICMLRPVSSEIKIDETEIQAAKWMPLEEFVKQPFIQEDHMFQKIMDICIQRLRKCYCGLTPHHVVSKFDDRTSTLYYNVAEPEDVNCSAA

SEQ ID NO: 4409 - protein, 374 aa, Sorghum bicolor
MESSLLDTAAAAGLCPAAAGRRHAGRAASFLSCSCASRDCRVSASYSHSISRMLSGVRSAARKKLFRTDQAADLLGIANWSDETSGGAGGHGHHQQQHWWTALEHNFVLEATDDEYGGVVVDADRLPDDKAAFARSLAASLSYWKSVGKKGVWLKLPVDRAEFVPLAVKEGFKYHHAEEAYLMMTYWIPDEPNMLPANASHQVGVGGFVINDQMEVLVVQEKYRGSSLDGVWKLPTGFILASEEIYTGASREVKEETGVDTEFVDVVAFRHAHNVAFQKSDLFFICMLRPVSSEIKIDETEIQAAKWMALEEFVKQPFIQEDHMFQKIMDICIQRLRKCYCGLTPHHVVSKFDDRTSTLYYNVAEPEDVNCSAT

SEQ ID NO: 4410 - protein, 369 aa, Panicum virgatum
MESSLLDTAAAAASLCAAAGGRRRAGSTASFLSCSCSPRDCRVSASYSRSISRMLSGVRSAARRKLFRADPADLLGVANWPEAGGAGHQQQQHWWAALEHNFVLESTDDEYGGVVVDADRLPTDKAAFARSLAASLSYWKSVGKKGVWLKLPVDRAEFVPLAVKEGFKYHHAEESYLMMTYWIPDEPNMLPANASHQVGVGGFVINDQMEVLVVQEKYCGSLLDGVWKLPTGFILASEEIYTGASREVKEETGVDTEFVDVVAFRHAHNVAFQKSDLFFICMLRPLSSEIKIDETEIQAAKWMPLEEFVKQPFIQEDHMFQKIMDICIQRLRKCYCGLTPHHVVSRFDDRTSTLYYNVAEPEDVNCSAT

SEQ ID NO: 4411 - protein, 353 aa, Pennisetum glaucum
GSLYPAAAAGRTAAGFLSCSSSSRDCRVSASYSHSISRMLSGVRSAARKKLFRADPAELLGVASWPETGGAGQQQQHWWTALEHNFVLEAIDDEYGGVVVDADRLPADKAAFERSLAASLSYWKSVGKKGVWLKLPVDRAEFVPLAVKEGFKYHHAEESYLMMTYWIPDEPNMLPANASHQVGVGGFVINDQMEVLVVQEKYHGSSLDGVWKLPTGFILASEEIYTGASREVKEETGVDTEFVDVVAFRHAHNVAFQKSDLFFICMLRPVSSEIKIDETEIQAAKWMPLEEFVKQPFIQEDHMFQKIMDICIQRLRKCYCGLTPHHVVSKFDDRTSTLYYNVAEPEDVNCSAA

SEQ ID NO: 4412 - protein, 362 aa, Brachypodium distachyon
MESCSLVDTATATLCSTAGGRRRARSGTRFLNCSSSSKEHGVSASCSIGRMLSGAKSAARRKLFRSEPDWLGLDWSDTSGAAGHHWWTTLENNFVLEASEDEYGGVVVDADRLPSDQAAFAGSLAASLSYWKSVGKKGVWLKLPVDRSEFVPIAVKEGFKYHHAEESYLMLTYWIPDEPSLLPANASHQVGVGGFVINDQMEVLVVQEKYRGSPMDGVWKLPTGFILASEEIFTGAIREVKEETGVDTEFVDVVAFRHAHNVAFQKSDLFFICMLRPVSSQIKIIDETEIQAAKWMPLEEFVKQPFIQEDHMFQKIMDICIQRLRKCYCGLTAHDVVSKFDGRASTLYYNVDEPEDVNCSAA

SEQ ID NO: 4413 - protein, 360 aa, Secale cereale
MESCSLVDTAAAAALCSTPGGRRRGRAGSARGSQLLQLLQRARGERVLLHRPDAERGEVGGAEEAVQERARVDGRQLAGLRRPPLVDHSREQLRAGGFRGRVRGVVVDADRLPADEAAFARSLAASLSYWKSVGKKGVWLKLPVDRSEFVPIAVKEGFKYHHAEEAYLMLTYWIPDEPSLLPANASHQVGVGGFVINDQMEVLVVQEKYRGWALDGVWKLPTGFIQESEEIYTGAIREVQEETGVDTEFVDVVAFRHAHNVAFQKSDLFFICMLRPLSSAIKIDETEIQAAKWMPLEEFVKQPFIQEDHMFQKIMDICIQRLRKCYCGLTAHNVVSKFDGRQSTLYYNVGEPEDVNCDAA

SEQ ID NO: 4414 - protein, 361 aa, Secale cereale
MESCSLVDTAAAAALCSTPGGRRRGRAGSAARFFNCSSSSREHGVSASYSIGRMLNGVRSAARRKLFRSEPEWMGVNWPDSAGHHWWTTLENNFVLEASEDEYGGVVVDADRLPADEAAFARSLAASLSYWKSVGKKGVWLKLPVDRSEFVPIAVKEGFKYHHAEEAYLMLTYWIPDEPSLLPANASHQVGVGGFVINDQMEVLVVQEKYRGWALDGVWKLPTGFIQESEEIYTGAIREVQEETGVDTEFVDVVAFRHAHNVAFQKSDLFFICMLRPLSSAIKIDETEIQAAKWMPLEEFVKQPFIQEDHMFQKIMDICIQRLRKCYCGLTAHNVVSKFDGRQSTLYYNVGEPEDVNCDAA

SEQ ID NO: 4415 - protein, 360 aa, Triticum aestivum
MESCSLVDTAAAALCSTAGGRRRGSAGNTMRFFNCSSSSREHGVSASYSIGRMLSGVRSAARRKLFRSEPEWMGVNLPDSTGHHWWTTLENNFVLEASEDEYGGVVVDADRLPSDEAAFARSLAASLSYWQSVGKKGVWLKLPVDRSEFVPIAVKEGFKYHHAEEAYLMLTYWIPDEPSLLPANASHQVGVGGFVINDQMEVLVVQEKYRGWALDGVWKLPTGFIQESEEIYTGAIREVQEETGVDTEFVDVVAFRHAHNVAFQKSDLFFICMLRPLSSAIKIDETEIQAAKWMPLEEFVKQPFIQEDHMFQKIMDICIQRLRKCYCGLTAHNVVSKFDGRQSTLYYNVGEPEDVNCDAA

SEQ ID NO: 4416 - protein, 361 aa, Triticum aestivum
MESCSLVDTAGAAALCSTPGGRRRGSAGNTMRFFNCSSSSREHGVSASYSIGRMLSGVRSAARRKLFRSEPEWMGVNWPDSTGHHWWTTLENNFVLEASEDEYSGVVVDADRLPADEAAFARSLAASLSYWQSVGKKGVWLKLPVDRSEFVPIAVKEGFKYHHAEEAYLMLTYWIPDEPSLLPANASHQVGVGGFVINDQMEVLVVQEKYRGWALDGVWKLPTGFIQESEEIYTGAIREVQEETGVDTEFVDVVAFRHAHNVAFQKSDLFFICMLRPLSSAIKIDETEIQAAKWMPLEEFVKQPFIQEDHMFQKIMDICIQRLRKCYCGLTAHNVVSKFDGRQSTLYYNVGEPEDVNCDAA

SEQ ID NO: 4417 - protein, 368 aa, Oryza sativa
MESSLVDTAAATLCLAAAVGGRRRAGSFLNCSCSSKEYRVSASYSIGRMLSGVRSAARKKLFRSEPADLLGISWSPDSPPSNGTDGGHHHHWWTALENNFVLESSEDEYGGVVVDADRLPSDKAAFARSLAASLSYWKSVGKKGVWLKLPVDRSEFVPIAVKEGFKYHHAEEAYVMLTYWIPHEEPCMLPANASHQVGVGGFVINDQMEVLVVQEKYCGSSLDGAWKLPTGFILASEEIFTGATREVKEETGVDTEFVDVVAFRHAHNVAFQKSDLFFICMLRPTSNNIKIDETEIQAAKWMPLEEFVKQPFIQGDHMFQKIMDICIQRLRKCYCGLTAHNVISRFDGRRSTLYYNVSEPEDVNCNAS

SEQ ID NO: 4418 - protein, 161 aa, Sorghum bicolor
MLGLRGLPAAPPAAAAPPKGRCSAAAPPPAMTGRLSLAVPAAVSLSLVLWSSPVNAGILSGFSGLESTPGPDLPRLEFLEKWNAENQKKYAEFDNRFKKSKVLQDLLEKSKKNKEKNERMIQDKYCLRGAEWGVGDCSTEGMTDQEREDFISELKKRTGAE

SEQ ID NO: 4419 - protein, 161 aa, Saccharum officinarum
MLGLRGVPAAPPAASAPSKGRCSAAPPPPAMTGRVLLALPAAVSLSLVLWSSPVNAGILSGFSGLESTPGPDLPRLEFLEKWNAENQKKYAEFDNRFKKSKVLQELLEKSKKNKEKNERLIQDKYCLRGAEWGVGDCSTEGMTDQEREDFISELKKRTGAE

SEQ ID NO: 4420 - protein, 158 aa, Setaria italica
MLGLVAAPAPAAAAPPRGRCGAAAPSEKAGRVALAVPAAATLSLVLWSSPANAGILSGFSGLESRPGPDMPRLEFLEKWNAENQKKYAEFDNRFKNSKVLQDLLEKSKKNKEKNERMIQDKYCLRGAEWGVGDCSTEGMSDQEREDFISELKKRTGAE

SEQ ID NO: 4421 - protein, 161 aa, Cynodon dactylon
MLGLGGLLAASPAAAAPPRTRCSAATPPERTGRAVSLAIPAAASLSLVLWSSPVNAGILSGSTGLESVPGPDLPRVEFLEKWNAENQKKYAEFDNRFKNSKVLQELLERSKKNKEKNERQIQDKYCLRGAEWGVGDCSTEGMTDQEREDFISELKKRTGAE

SEQ ID NO: 4422 - protein, 451 aa, Sorghum bicolor
MAVEILESCMVKPSDDAGTTTTPMHVVWLSNLDLLVARSHTPTIYVYRRPASPDVPGFFSPDVLKAALSKALVPFYPLAGRLAQDGAGRPEIHCTGDGALFVTARADVTLQDLATAGGLAPSDELRQMLVPSAADDGEDRAGILAMFQVTSFKCGGVCVGAAIHHTAADGLAALDFVNTWAAIASKGVDEAAPRPWLDRTLLRARSPPDVRFDHSEYSRRGGGDPKAARVPFDSAILPMSKAQLDALKGGGGEGSKKVSTFKAVVAHVWRCACTARGLAQDEDTRLYMTADARSRVRPPLPEGYLGNAIFRASTVAKAGDVVSEPLDAVAGRVSGATARLDDEYVRSLVDCLEQVVSDAAGLRKGEWVMPETDLWVISWQGLPIYDADFGWGRPAFMGRACLQFSGLVYLVPGPDGDGRLDVVVAMEPKSLARFKELFYELEGAAVPCMAN

SEQ ID NO: 4423 - protein, 178 aa, Sorghum bicolor
MAVEILESCMVKPSDDAGTTTTPMHVVWLSNLDLLVARSHTPTIYVYRRPASPDVPGFFSPDVLKAALSKALVPFYPLAGRLAQDGAGRPEIHCTGDGALFVTARADVTLQDLATAGGLAPSDELRQMLVPSAADDGEDRAGILAMFQVTRVRRDDLIRSPHVPYLLVVALRTVMRRR

SEQ ID NO: 4424 - protein, 705 aa, Setaria italica
MAVVEILESCMVTPSDAATPKHGVWLSNLDLLVARSHTPTIYVYRPSPGPGLLLAGRPQGRPVPGATRYYPLAGRLGLDGAGRPEIHCTGDGVLFVTARTDAALQDLGGFVPSDELRRMLVPSADGGGDERAGILAMFQVTFFKCGGVCVGAAIHHMAADGLAALDFVNTWAAIARGAGGEAAPRRPWLDRTLLRARSPPDVRFDHAEYSRRGGGGSKAPFDSAILPVSRAQVDALKGGKKLSTFKAVVAHVWRCACRARGLAAAEDTRLYMTADARSRVTPPLPDGYLGNAIFRASAVAKVGDVVSGSLDAAADMISGATARLDDEYVRSLVDHLEQVVSDAAGLRKGEWVMPETDLWVISWQGLPIYDADFGWGRPAFMSRACLQFSGLVYLVPGPDGDGRLDVVVAMEPKSLARFKELLYEDLNPKHTNWNMMATSNVSHQAATPPEPLRGRVAIVTGGSGGIGAAVTAHLASLGARVVVGYVGDPAPADQLVAALNSGSRPPAAPPRAVAVDADVSDPAQVARLFDAAEAAFGPDLHVLVAAAGVQDAAYPRIADTTPEQWDAAFGVNARGAFLCCREAARRLVRGGGGRIVTFSSSNVGSLRPGYGAYVATKAAVEAMTKVLAKELAGTGITANSVAPGPIATPMFYAGKTEERVAAAARECPMGRIGEPEDVAPVVGFLCTDEAGWINGQVIRVNGGYV

SEQ ID NO: 4425 - protein, 344 aa, Sorghum bicolor
MNVVVPPQSPHLRLYEFAKSALIRIFAFPYATVCDLYCDGGVDTDKWCDCQVGHYIGIDASASGVNDARELWDNKRKPFTAEFIELDPTDDGFEAQVQEKGIQADMVCCMQHLQLCFESEERAKKLLNNVSSLLKPGGYFFGLTPDSSTIWTKYQKNVEASHNKGLKAVPNSIRSENYTITFEVEEEKFPVFGKKYQLKFASDAVFENHCLVHFPSLLRLAREAGLEYVEIQNLTEFYDDNRTQFAPMLGGYSASFLDARGKLVARSYDILGLYSTFVFQKPDPDAIPPIVSPDLHDPDNAHEEQEWLQPQQASVEDERRLHADVLPIDPAKGILGPGPADMRL

SEQ ID NO: 4426 - protein, 344 aa, Setaria italica
MNVAVPPPPPPHLRLYEFAKTALIKIFSFPYATVCDLYCDGGVDTDKWCDAQVGHYIGIDASASGVSDARELWENKRKPFTAEFIELDPSDDDFEAQVQEKGIQADIVCCMQHLQLCFESEERAKKLLNNVSSLLKPGGYFFGMTPDSSTIWTKYQKNVEASHNKGLKTVPNSIRSENYTITFEVEEEKFPFFGKKYQLKFASEAVFENHCLVHFPSLMRLAREAGLEYVEIQNLTEFYDDNRIQFAPMLGGYSASFLDARGKLVTRSYDILGLYSTFVFQKPDPDAIPPIVTPDLHDTDNAHEEEWLRRQQASADDGRRSHTDVLPLDHEKGILGPGPADMRL

SEQ ID NO: 4427 - protein, 142 aa, Saccharum officinarum
MNVVVPPQPAHLRLYEFAKSALIRIFAFPYATVCDLYCDGGVDTDKWCDAQVGHYIGIDASATGVNDARELWENKKKPFTAEFIELDPSDDGFEAQVQEKGIQADMVCCMQHLQLCFESEERAKKLLNNVSSLLKPGGYFLA

SEQ ID NO: 4428 - protein, 350 aa, Panicum virgatum
GPPLITEMNVAAPPPPPPHLRLYEFAKTALVKIFAFPYATVCDLYCDGGVDTDKWCDAQVGHYIGIDASASGVSDARELWENKRKPFTAEFIELDPSDDDFEAQVQEKGIQADIVCCMQHLQLCFESEERAKKLLNNVSSLLKPGGYFFGMTPDSSTIWTKYQKNVEASHNKGLKAVPNSIRSENYTITFEVEEEKFPFFGKKYQLKFASEAVSENHCLVHFPSLMRLAREAGLEYVEIQNLTEFYDDNRTQFAPMLGGYSASFLDARGKLVTRSYDILGLYSTFVFQKPDPDAIPPIVTPDLHDTDNAQEEDWLRRQQAADDGRCPHADVLPLDHEKGILGPGPADMRL

SEQ ID NO: 4429 - protein, 352 aa, Sorghum bicolor
MNVVVPPQSPHLRLYEFAKSALIRIFAFPYATVCDLYCDGGVDTDKWCDCQVGHYIGIDASASGVNDARELWDNKRKPFTAEFIELDPTDDGFEAQVQEKGIQADMVCCMQHLQASWLFSGTLCFESEERAKKLLNNVSSLLKPGGYFFGLTPDSSTIWTKYQKNVEASHNKGLKAVPNSIRSENYTITFEVEEEKFPVFGKKYQLKFASDAVFENHCLVHFPSLLRLAREAGLEYVEIQNLTEFYDDNRTQFAPMLGGYSASFLDARGKLVARSYDILGLYSTFVFQKPDPDAIPPIVSPDLHDPDNAHEEQEWLQPQQASVEDERRLHADVLPIDPAKGILGPGPADMRL

SEQ ID NO: 4430 - protein, 316 aa, Sorghum bicolor
MFLADKYSSLLPSLHQHHSKPSRRRSQQLKGEADRFGAALAARLRGLLPLPASQLAALARVADLLALTLADAGDALAGAGEGDASAAAVAAHLDAGVALLDACNAIAVRLDRLRRRRLLARLALHLLSSTSSSPSGRARARAALADRGDHPAASPSPLAPLPSLPFEQPRGRLSAAARVLAAVDAVSSLAAAAAAAILVGGPASFPRVSGGGDLPWAEPFNAVSGQLAALEGAGEVGAVDEAVRSLASALDAGTDNEAAVRPAAQELERRTEELAPRLDRLSDAVGGVFRAALGLRNAELGCFMVGPAGKPCSKYP

SEQ ID NO: 4431 - protein, 322 aa, Sorghum bicolor
MAPAAAAVVAAASPAALLGSSSPRSRRPQGRACSFRCDGPTLVSSSLKSSSCAGHHPRIRQPYGRPHCSQQQAEVVGSSTVDDDEACELVSGSDLVIGEGDDSVSAYLFKAVKNNNGTGILLLSDIFGFEDSATRDFAYRVACNGYNVLVPDLFRGNPWKLNLPFDGDSFQQWLAGHAPGRVSGDIDACTRWLVDEFKAAGVSKKLGVVGFCYGGGRLVETLARDADSCFSAGVCFYGSRMDASLGDRIAAPVLFVCGDGDPLCAVETVRELERRARGGARAAVYAGRGHGFAHRPQSVEEDADAENAFNVMRGWLHDHLLA

SEQ ID NO: 4432 - protein, 507 aa, Sorghum bicolor
MSFRDQESGGEDAGRTSSASDLRKPLLNTGSWYRMPPPGGMMGSRQSSLMERLGSSAFSLRDVAISATLCTLIVALGPIQFGFTCGYSSPTQDAIIADLGLSLSEFSLFGSLSNVGAMVGAISSGQLAEYIGRKGSLMIAAIPNIIGWLAISFAKDSSFLFMGRLLEGFGVGVISYTVPVYIAEIAPQDQRGALGSVNQLSVTVGILLAYLFGMFVPWRILAVLGILPCSILIPGLFFVPESPRWLAKMGKMEDFEYSLQVLRGFQTDITAEVNEIKRSVASSRRRTTAIRFADIKQKRYSVPLAIGIGLLVLQQLSGVNGILFYAGSIFKAAGITNSNLATFGLGAVQVIATGVTTWLTDKAGRRLLLIISTTGMVITLVIVSVSFFVKDNITAGSHLYSAMSMLSLAGLVAFVIAFSLGLGAIPWVIMSEILPVNIKSLAGSVATLANWLTAWAITMTASLMLNWSNGGTFAIYAAVSAMALIFVCLWVPETKGRTLEEIAFSFR

SEQ ID NO: 4433 - protein, 503 aa, Saccharum officinarum
MSFRDQESGGEDAGRTSSSSDLRKPLLNTGSWYRMPPAGGMMGSRQSSLMERLGSSAFSLRDVAISATFCTLIVALGPIQFGFTSGYSSPTQDAIIADLGLSLSEFSLFGSLSNVGAMVGAISSGQLAEYIGRKGSLMIAAIPNIIGWLAISFAKDSSFLFMGRLLEGFGVGVISYTVPVYIAEIAPQDQRGVLGSVNQLSVTIGILLAYLFGMFVPWRILAVLGVLPCSILIPGLFFVPESPRWLAKMGKMEDFEYSLQVLRGFQTDITAEVNEIKRSVASSRRRTTIRFADIKQKRYSVPLAIGIGLLVLQQLSGVNGILFYAGSIFKAAGITNSNLATFGLGVVQVIATGVTTWLTDKAGRRLLLIISTTGMVITLVIVSVSFFVKDNITAGSHLYSTMSMLSLAGLVAFVIAFSLGLGAIPWVIMSEILPVNIKSLAGSVATLANWLTAWAITMTASLMLNWSNGGTFAIYAAVSTMALIFVCLWVPETKGRTLEEIAF

SEQ ID NO: 4434 - protein, 506 aa, Panicum virgatum
MSFRDQESGGEDGVRTSSASDLRKPLLNNGSWYRMPPPGGIMGSRQSSLMERLGSSAFSIRDVSVSATLCTLIVALGPIQFGFTCGYSSPTQDAVVADLGLSLSEFSLFGSLSNVGAMVGAIASGQIAEYIGRKGSLMIAAIPNIIGWLAISFAKDSSFLFMGRLLEGFGVGVISYTVPVYIAEIAPQDQRGALGAVFQLSVTIGILLAYLFGMFVPWRILAVLGILPCSILIPGLFFVPESPRWLAKMGKMEDFEYSLQVLRGFQTDITAEVNEIKRSVASSRRRTTIRFADIKQKRYSVPLMIGIGLLVLQQLSGVNGILFYAASIFKAAGITNSNLATFGLGVIQVIATGVTTWLSDKAGRRLLLIISTTGMTITLVVVSVSFFVKDNITAGSHLYSVMSMLSLAGLVAFVISFNLGLGAIPWIIMSEILPVSIKSLAGSVATLANWLGAWAVTMTASLMLSWSNGGTFAIYAAVCTMALIFVCLWVPETKGRTLEEIAFSFR

SEQ ID NO: 4435 - protein, 502 aa, Setaria italica
MSFRDQESGGEDGGRADLRKPLLNTGSWYRMPPAGGMMGSRQSSLMERLGSSTFSLRDVSVSATLCTLIVALGPIQFGFTCGYSSPTQDAVIADLGLSLSEFSLFGSLSNVGAMVGAIASGQIAEYIGRKGSLMIAAIPNIIGWLAISFAKDSSFLFMGRLLEGFGVGVISYTVPVYIAEIAPQDQRGALGAVFQLSVTIGILLSYLFGMFVPWRILAVLGVLPCTILIPGLFFVPESPRWLAKMGKTEDFEYSLQVLRGFQTDITAEVNEIKRSVASSRRRTTIRFADIKQKRYSVPLMIGIGLLVLQQLSGVNGILFYAASIFKAAGITNSNLATFGLGVVQVIVTGVTTWLSDKAGRRLLLIISTTGMTITLVVVSVSFFVKDNITAGSHLYSVMSMLSLAGLVAFVISFNLGLGAIPWIIMSEILPVSIKSLAGSVATLANWLGAWVITMTASLMLSWSNGGTFAIYAAVCTMALIFVCLWVPETKGRTLEEIAFSFR

SEQ ID NO: 4436 - protein, 491 aa, Pennisetum glaucum
GGRADLRKPLLNTGSWYRMPPPAGGMMGSRQSSLMERLGSSTFSLRDVSVSATLCTLIVALGPIQFGFTCGYSSPTQDAVIADLGLTLSEFSLFGSLSNVGAMVGAIASGQIAEYIGRKGSLMIAAIPNIIGWLAISFAKDSSFLFMGRLLEGFGVGVISYTVPVYIAEIAPQDQRGALGAVFQLSVTIGILLSYLFGMFVPWRILAVLGILPCTILIPGLFFVPESPRWLAKMGKTEDFEYSLQVLRGFQTDITAEVNEIKRSVASSRRRTTIRFADIKQKRYSVPLMIGIGLLVLQQLSGVNGILFYAASIFKAAGITNSNLATFGLGVVQVIATGVTTWLSDKAGRRVLLIISTTGMTITLVVVSVSFFVKDNIAAGSHLYSVMSMLSLAGLVAFVISFNLGLGAIPWIIMSEILPVSIKSLAGSVATLANWLGAWAVTMTASLMLSWSNGGTFGIYAAVCTMALIFVCLWVPETKGRTLEEIAFSFR

SEQ ID NO: 4437 - protein, 502 aa, Brachypodium distachyon
MSFRDESGGEDGGGASDLRKPLLHTGSWYRMSAAAGLGSRQSSSLMDRLGSSAYALRDGAVSAVLCTLIVALGPIQFGFTCGYSSPTQDAIIADLGLSLSEFALFGSLSNVGAMVGAIASGQIAEYIGRKGSLMIAAIPNIIGWLAISFAKDSSFLFMGRLLEGFGVGVISYTVPVYIAEIAPQNMRGALGAVNQLSVTIGILLAYTLGMFVPWRILSVLGILPCSILIPGLFFIPESPRWLAKMGKMEDFESSLQVLRGFERDITAEVNEIKRSVASSRRRTTIRFADIKQKRYSVPLMIGIGLLVLQQLSGVNGILFYAASIFKAAGIQNSNLATCGLGAVQVIATGITTWLTDKAGRRLLLIISTTGMTITLVVVSVSFFVKDNVTEGSHLYSIMSMLSLAGLVAFVISFSLGLGAIPWIIMSEILPVNIKSLAGSVATLANWMTSWLITMTASLMLSWSNGGTFAIYAAVCTGTLLFVCLCVPETKGRTLEEIAFSFR

SEQ ID NO: 4438 - protein, 501 aa, Oryza sativa
MSFRGEESGGEDGGRTASASDLRKPFLHTGSWYKMSSAGGGGGMGSRLGSSAYSLRDSSVSAVLCTLIVALGPIQFGFTCGFSSPTQDAIISDLGLTLSEFSLFGSLSNVGAMVGAIASGQIAEYIGRKGSLMIAAIPNIIGWLAISFAKDSSFLFMGRLLEGFGVGVISYVVPVYIAEIAPQTMRGALGSVNQLSVTIGILLAYLLGMFVPWRILSVLGILPCSILIPGLFFIPESPRWLAKMGKMEDFESSLQVLRGFETDIAVEVNEIKRTVQSSRRRTTIRFADIKQKRYSVPLMIGIGLLVLQQLSGVNGILFYAASIFKAAGLTNSNLATFGLGVVQVVATGVTTWLTDKAGRRLLLIISTTGMTITLVVVSVSFFVKDNITNGSHLYSVMSMLSLVGLVAFVISFSLGLGAIPWIIMSEILPVNIKSLAGSVATLANWLTAWLITMTASLMLSWSNGGTFAIYAAVCAGTLVFVCLWVPETKGRTLEEIAFSFR

SEQ ID NO: 4439 - protein, 500 aa, Secale cereale
MSFRDESGGEDGSGGRSSSASDLRKPFLHTGSWYRMSAAGGGAMDRLGSSAYGLRDSSISALLCTLIVALGPIQFGFTCGYSSPTQDAIMADLGLTLSEFSLFGSLSNVGAMVGAIASGQIAEYIGRKGSLMIAAIPNIIGWLAISFANDSSFLFMGRLLEGFGVGVISYTVPVYIAEIAPQNMRGALGSVNQLSVTIGILLAYTLGMFVPWRILSVLGILPCSILIPGLFFIPESPRWLAKMGKMEDFESSLQVLRGFETDISAEVNEIKRSVASSRRRTTIRFAEIKHKRYSVPLMIGIGLLILQQLSGVNGIFFYAASIFKAAGLKNSNLATCGLGAVQVVATGITTWLTDKAGRRLLLIISAVGMTVSLLVVSVSFFVKDNIDEASHLHSVMSILSLAALVAFVFAFSLGMGAIPWIIMSEILPVNIKSLAGSTATLANWMTSWLITMTASLMLNWSNGGTFAIYAAVSMGTLLFVCLCVPETKGRTLEEIAFSFR

SEQ ID NO: 4440 - protein, 526 aa, Secale cereale
ARESCHARHGSERAQPIRSEPARRRRDELPGRERRGGRQRGRSSSASDLRKPFLHTGSWYRMSAAGGGAMDRLGSSAYGLRDSSISALLCTLIVALGPIQFGFTCGYSSPTQDAIMADLGLTLSEFSLFGSLSNVGAMVGAIASGQIAEYIGRKGSLMIAAIPNIIGWLAISFANDSSFLFMGRLLEGFGVGVISYTVPVYIAEIAPQNMRGALGSVNQLSVTIGILLAYTLGMFVPWRILSVLGILPCSILIPGLFFIPESPRWLAKMGKMEDFESSLQVLRGFETDISAEVNEIKRSVASSRRRTTIRFAEIKHKRYSVPLMIGIGLLILQQLSGVNGIFFYAASIFKAAGLKNSNLATCGLGAVQVVATGITTWLTDKAGRRLLLIISAVGMTVSLLVVSVSFFVKDNIDEASHLHSVMSILSLAALVAFVFAFSLGMGAIPWIIMSEILPVNIKSLAGSTATLANWMTSWLITMTASLMLNWSNGGTFAIYAAVSMGTLLFVCLCVPETKGRTLEEIAFSFR

SEQ ID NO: 4441 - protein, 496 aa, Triticum aestivum
MNGGGDESGSDHEGGGGTRKPLLLKNTGSWYRMVGSSSRQIVGASSMAVLRESHVSALLCTLIVALGPIQFGFTCGYSSPTQDAIMADLGLTLSEFSLFGSLSNVGAMVGAIASGQIAEYIGRKGSLMIAAIPNIIGWLAISFANDSSFVFMGRLLEGFGVGVISYTVPVYIAEIAPQNMRGALGSVNQLSVTIGILLAYTLGMFVPWRILSVLGILPCSILIPGLFFIPESPRWLAKMGKMEDFESSLQVLRGFETDISAEVNEIKRSVASSRRRTTIRFAEIKHKRYSVPLMIGIGLLILQQLSGVNGIFFYAASIFKAAGLKNSNLATCGLGAVQVVATGITTWLTDKAGRRLLLIISATGMTISLLVVSVSFFVKDNIEEASHLHFVMSMLSLAGLVAFVLAFSLGMGAIPWIIMSEILPVNIKSLAGSTATLANWMTSWLITMTASLMLNWSNGGTFAIYAAVSMGTLLFVCLCVPETKGRTLEEIAFSFR

SEQ ID NO: 4442 - protein, 103 aa, Saccharum officinarum
MAEEKGALQSAREWVVEHKLRAVGTLWLSGIVGSIAYNWSRPGMKTSVKIIHARLHAQALTLAALAGSALVEYYDHQQGSGSRVHQYAKQFLSSDSSSSPQKE

SEQ ID NO: 4443 - protein, 105 aa, Saccharum officinarum
MAEEKGALQSAREWVVEHKLRAVGTLWLSGIVGSIAYNWSRPGMKTSVKIIHARLHAQALTLAALAGSALVEYYDHQQGSGSKVHQYAKQFLSSDSDSHSSPQKE

SEQ ID NO: 4444 - protein, 101 aa, Panicum virgatum
MAEEKSALQSAREWVVDHKLRAVGTLWLSGIVGSIAYNWSRPGMKTSVKIIHARLHAQALTLAALAGSALVEYYDHQQGSGSKVHQYAKQILSSDGSSQKE

SEQ ID NO: 4445 - protein, 101 aa, Panicum virgatum
MAEEKSALQSAREWIVDHKLRAVGTLWLSGIVGSIAYNWSRPGMKTSVKIIHARLHAQALTLAALAGSALVEYYDHQQGSGSKVHQYAKQFLSSDGSSQKE

SEQ ID NO: 4446 - protein, 101 aa, Setaria italica
MAEEKSALQSAREWVVDHKLRAVGTLWLSGIVGSIAYNWSRPGMKTSVKIIHARLHAQALTLAALAGSALVEYYDHQQGSGSKVHQYAKQFISSDGSSQNK

SEQ ID NO: 4447 - protein, 105 aa, Sorghum bicolor
MAEEKSALQSAREWVVEHKLRAVGTLWLSGIVGSIAYNWSRPGMKTSVKLIHARLHAQALTLAALAGSGLVEYYDHQQGSGSKVHQYAKQFLSSDADSSSSPQKE

SEQ ID NO: 4448 - protein, 101 aa, Pennisetum glaucum
MAEEKSALQSAREWVVDHKLRAVGTLWLSGIAASIAYNWSRPGMKTSVKIIHARLHAQALTLAALAGSALVEYYDHQQGSGSKVHQYAKQFISSDGGSQNK

SEQ ID NO: 4449 - protein, 101 aa, Avena sativa
MAEEKGTLQSMREWVVEHKLRAVGTLWLTGIAGSIAYNWSRPGMKTSVKLIHARLHAQALTLAALGGSALVEYYDHQSGSGSKVHSYAKQFLPADSNPKKE

SEQ ID NO: 4450 - protein, 101 aa, Avena sativa
MAEEKGTLQAMREWVVEHKLRAVGTLWLTGIAGSIAYNWSRPGMKTSVKLIHARLHAQALTLAALGGSALVEYYDHQSGSGSKVHSYAKQFLPADSNPKKE

SEQ ID NO: 4451 - protein, 101 aa, Brachypodium distachyon
MAEEKGALQSMRQWVVEHKLRAVGSLWLAGIAGSIAYNWSRPGMKTSVKLIHARLHAQALTLAALGGSALVEYYDHQSGSGSRVHQYAKQFLPPDSNPKKD

SEQ ID NO: 4452 - protein, 101 aa, Oryza sativa
MAEEKSTMQSMREWVVDHKLRAVGTLWLTGVASSIAYNWSRPGMKTSVKIIHARLHAQALTLAALAGSALVEYYDHRSGSGSRVHQYAKQFITPESNPQKE

SEQ ID NO: 4453 - protein, 102 aa, Festuca arundinacea
  misc_feature (7)..(7): Xaa can be any naturally occurring amino acid
  misc_feature (13)..(13): Xaa can be any naturally occurring amino acid
  misc_feature (25)..(25): Xaa can be any naturally occurring amino acid
MAEEKGXLQSARXWIVEHKLRAVGXLWLSGIAGSIAYNWSRPGMKTSVKLIHARLHAQALTLAALGGSALVEYYDHQSGSGSRVHNYAKQFLPPADTNPKKE

SEQ ID NO: 4454 - protein, 103 aa, Secale cereale
MAEEKGTLQAMRGWVVDHKLRAVGTLWLTGIAGSIAYNWSRPGMKTSVKLIHARLHAQALTLAALGCSALVEYYDHQSGSGSKVHDYAKQFLPSDRNTKKDSV

SEQ ID NO: 4455 - protein, 103 aa, Unknown
  Sequence found in Organisms: Secale cereale, Triticum aestivum
MAEEKGTLQAMRGWVVDHKLRAVGTLWLTGIAGSIAYNWSRPGMKTSVKLIHARLHAQALTLAALGCSALVEYYDHQSGSGSKVHDYAKQFLPSDRNAKKDSV

SEQ ID NO: 4456 - protein, 103 aa, Hordeum vulgare
MAEEKGTLQAMRGWVVDHKLRAVGTLWLTGIAGSIAYNWSRPGMKTSVKLIHARLHAQALTLAALGCSALVEYYDHQSGSWSKVHDYAKQFLPSERNAKKDSV

SEQ ID NO: 4457 - protein, 103 aa, Hordeum vulgare
MAEEKGTLQAMRGWVVDHKLRAVGTLWLTGIAGSIAYNWSRPGMKTSVKLIHARLHAQALTLAALGCSALVEYYDHQSGSGSKVHDYAKQFLPSERNAKKDSV

SEQ ID NO: 4458 - protein, 97 aa, Saccharum officinarum
MASAYASWSKRWIRPEVYPLFVPMAAALGICSYQLVRNITGNPEVRVTKEKRAAGVLDNHDEGERYAMHGLRKFVRGKKPEIMASINSFFADPPKDD

SEQ ID NO: 4459 - protein, 97 aa, Sorghum bicolor
MASAYASWSKRWIRPEVYPLFVPMAAALGICSYQLVRNITGNPEVRVTKEKRAAGVLDNHDEGEKYAMHGLRKFVRGKKPEIMASINSFFADPPKDG

SEQ ID NO: 4460 - protein, 441 aa, Sorghum bicolor
MHPQRMKQAAAQQQLMQQALLLQQQQAQQPPLFPGHHHPHPGLLAAPQMEPIVSGNLPPGFDSSTCRSVYVGNISLQVTDTVLQEVFQSIGPVEGCKLIRKEKSSFGFIDYYDRRYAALAILSLNGRPLYGQPIKVNWAYTSTQREDTSGHFNIFVGDLCPEVTDATLFAFFSGYSTCSDARVMWDQKTGRSRGFGFVSFRNQQDAQSAINDLNGKWLGNRQIRCNWATKGANAGEEKQIVDSKVDLTNGTSESGKENPNEDGPESNPQFTTVYVGNLPHEATNNDVHLFFHSLGAGSIEEVRVTRDKGFGFVRYSTHEEAAQAIQMANGQLIGGRQIKCSWGSKPTPPGTASSPLPPPAPALFSTGVSPTDFLAYQRMALNKMATNPSLMGQHALNQVALGMGGRASQSIYDGGFQGISTAAATTSAQQQQQQQQQLMYY

SEQ ID NO: 4461 - protein, 425 aa, Triticum aestivum
MQQALLMHHHQQQQQAAAAVPPMFPPHHAHPGLLAAPHIEPIVSGNLPPGFDSSTCRSVYVGNIHLQVTDSLLHEVFQSIGPVEGCKLIRKEKSSFGFVDYYDRRYAALAIVSLNGRQLFGQPIKVNWAYASTQREDTSGHFNIFVGDLCPEVTDAALFAFFSAYSTCSDARVMWDQQTGRSRGFGFVSFRNQQDAQTAINELNGKWLGNRQIRCNWATKGANAGEEKQSTDSKGVVELINGSSEPGKENANEDGPENNPQYTTVYVGNLPHDINSNDVHRFFHLLGAGSIEEVRVTRDKGFGFVRYSTHEEAAQAIQTGNGQLIGGRQIKCSWGSKPTPPGTASAPLPPPALAPYTPGVSAVDLISYERSLALSKMAANPALMGQHAALRQAAMGMGAGASQAIFDGGFQSVNPQQQQQQLMYY

SEQ ID NO: 4462 - protein, 430 aa, Triticum aestivum
MQQALLMHHHQQQQQAAAAVPPMFPPHHAHPGLLAAPHIEPIVSGNLPPGFDSSTCRSVYVGNIHLQVTDSLLHEVFQSIGPVEGCKLIRKEKSSFGFVDYYDRRYAALAIVSLNGRQLFGQPIKVNWAYASTQREDTSGHFNIFVGDLCPEVTDAALFAFFSAYSTCSDARVMWDQQTGRSRGFGFVSFRNQQDAQTAINELNGKWLGNRQIRCNWATKGANAGEEKQSTDSKGVVELINGSSEPGKENANEDGPENNPQYTTVYVGNLPHDINSNDVHRFFHLLGAGSIEEVRVTRDKGFGFVRYSTHEEAAQAIQTGNGQFIGGRQIKCSWGSKPTPPGTASAPLPPPALAPYTPGVSAVDLISYERSLALSKMAANPALMGQVAALRQAAMGMGTGASQAIFDGSFQSVNPQQQQQQQQQQQLMYY

SEQ ID NO: 4463 - protein, 436 aa, Hordeum vulgare
MQQRMKQAAAGAAQQQQQMMQQALHQQQQQAAAAVPPMFPPHHAHPGLLAAPHIEPIVSGNLPPGFDSSTCRSVYVGNIHLQVTDSLLHEVFQSIGPVEGCKLIRKEKSSFGFVDYYDRRYAALAIVSLNGRQLFGQPIKVNWAYASTQREDTSGHFNIFVGDLCPEVTDAALFVFFSAYSTCSDARVMWDQQSGRSRGFGFVSFRNQQDAQTAINELNGKWLGNRQIRCNWATKGANAGEVKQSTDSKGMVELISGSSEAGKENANEDGPEDNPQYTTVYVGNLSHDIDSNDVHRFFHLLGAGSIEEVRVTRDKGFGFVRYSTHEEAAQAIQTGNGQLIGGRQIKCSWGSKPTPPGTASAPLPPPASAPYTPGVSAADLISYERSLALSKMAANPALMGQHAALRQAAMGAGASQAIYDGGFQSVNPQQQQLMYY

SEQ ID NO: 4464 - protein, 441 aa, Oryza sativa
MQHQQRMKQAAAAAQQQQMMQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 4465 - protein, 422 aa, Oryza sativa
MQQALLMQQQQAAAVAAAAQQQQAPLFPPHHPHPGLLAAPQIEPIVSGNLPPGFDSSTCRSVYVGNIHLQVTDSLLHEVFQSIGPVEGCKLIRKEKSSFGFVDYYDRRSAAIAIVSLNGRQLFGQPIKVNWAYASTQREDTSGHFNIFVGDLCPEVTDAALFAFFAGFTSCSDARVMWDQKTGRSRGFGFVSFRNQQDAQNAINELNGKWLGNRQVRCNWATKGANAGEEKQNTDSKGMIELTNGSSEGGKDNANEDGPENNPQYTTVYVGNLPHDVNSNDVHRFFHSLGVGSIEEVRVTRDKGFGFVRYSTHEEAALAIQTGNGQLIGGRQIKCSWGSKPTPPGTASAPLPPPAPAPFNPGMSATDLLAYERTLALSKMAANPALMSQHAALKQAAAMGMGAGASQAIYDGGYQSANAVFY

SEQ ID NO: 4466 - protein, 457 aa, Setaria italica
MGLEMEAMAASIGVSVPVLRFLLCFAATIPTGLLWRAVPGATGRHLYAGLTGAALSYLSFGATSNLLFVVPMALGYLAMLLFRRHAGLITFLGAFGFLIACHVYYMSGDAWKEGGIDATGALMVLTLKVISCAINYSDGILKEEGLRDAQKKYRLTKLPSLIEYFGYCLCCGSHFAGPVYEMKDYLDWTERKGIWASPTPSPLLPTLRALVQAGICMGLYLYLSPKFPLSRFSEPLYYEWGFWHRLFYQYMSGFTARWKYYFIWSISEAAIIISGLGFTGWSESSPPKAKWDRAKNVDVLGVELAGSAVQLPLVWNIQVSTWLRYYVYERLIQKGKKPGFLQLLGTQTVSAVWHGLYPGYIIFFVQSALMINGSRVIYRWQQTVNNSVFRGILAFLNFAYTLLVLNYSCIGFQVLSFKETLASYQSVYYVGTIVPIVCVLLGNVIKPARKPKAQKAE

SEQ ID NO: 4467 - protein, 460 aa, Pennisetum glaucum
MGLEMEAMAASIGVSVPVLRFLLCFAATIPTGLLWRAVPGATGRHLYAGLTGAALSYLSFGATSNLLFVVPMALGYLAMLLFRRHAGLITFLGAFGFLIACHVYYMSGDAWKEGGIDATGALMVLTLKVISCAINYSDGILKEEGLRDAQKKYRLTKLPSLIEYFGYCLCCGSHFAGPVYEMKDYLDWTERKGIWASATPSPLLPTLRALVQAGICMGLYLYLSPKFPLSRFSEPLYYEWGFWHRLFYQYMSGFTARWKYYFIWSISEAAIIISGLGFTGWSESSPPKAKWDRAKNVDVLGVELTGSAVQLPLVWNIQVSTWLRYYVYERLIQKGKKPGFLQLLGTQTVSAVWHGLYPGYIIFFVQSALMINGSRVIYRWQQAVNNSVFRSILAFLNFAYTLLVLNYSCIGFQVLSFKETLASYQSVYYVGTIVPIACLLLGNVIKPARKPKTQKAQKAE

SEQ ID NO: 4468 - protein, 459 aa, Brachypodium distachyon
MGLEMEPMAAAIGVSVPVLRFLLCFAATIPTGLLWRAVPGATGRHLYAGLSGAALSYLSFGATSNLLFVVPMALGYLAMLLCRRHAGLVTFLGALGFLIACHVYYMSGDAWKEGGIDATGALMVLTLKVISCAINYSDGLLKEEGLRDAQKKYRLAKLPSLVEYFGYCLCCGSHFAGPVYEMKDYLDWTERKGIWAGSTPSPLLPTLRALVQAGICMSLYLYLSPRFPLSRFSEPLYYEWGFWHRLFFQYMSGFTARWKYYFIWSVSEASVIISGLGFTGWSDSSPPKAKWERAINVDILGVELAGSAVQLPLKWNIQVSTWLRYYVYERLIQKGKKPGFLQLLGTQTVSAIWHGLYPGYMIFFVQSALMINGSRVIYRWQQAVSNSVLHTILTLLNFAYTMMVLNYSCIGFQVLSFQETLASYKSVYYVGTIVPILCVLLGYVIKPARPVKPKARKAE

SEQ ID NO: 4469 - protein, 457 aa, Panicum virgatum
MGLEMEEMAASIGVSVPVLRFLLCFAATIPTGLLWRAVPGATGRHLYAGLTGAALSCLSFGATSNLLFVAPMALGYLAMLLFRRHAGLITFLGAFGFLIACHAYYMSGDAWKEGGIDATGALMVLTLKVISCAINYSDGILKEEGLREAQKKYRLTKLPSLIEYFGYCLCCGSHFAGPVYEMKDYLDWTERKGIWASSTPSPLLPTLRAIVQAGICMGLYLYLSPKFPLSWFSEPLYYEWGFWHRLFYQYMSGFTARWKYYFIWSISEAAIIISGLGFTGWSESSPPKAKWDRAKNVDVLGVELAGSAVQLPLMWNIQVSTWLRYYVYERLIQKGKKPGFLQLLGTQTVSAIWHGLYPGYIIFFVQSALMINGSRVIYRWQQAVSNSVLRSILAFLNFAYTLLVLNYSCIGFQVLSFKETLASYQSVYYVGTIFPIVCLLLGNVIKPARKPKAQKAE

SEQ ID NO: 4470 - protein, 460 aa, Secale cereale
MGLEMEPMAAAIGVSVPVLRFLLCFAATIPTGLLWRAVPSAAGRHLYAGLSGAALSYLSFGATSNLLFVGPMALGYLAMLLCRRRAGLVTFLGAFGFLIACHVYYMSGDAWKEGGIDATGALMVLTLKVISCSMNYSDGLLNEEEGLRDAQKKYRLAKLPSLIEYFGYCLCCGSHFAGPVYEMKDYLEWTERKGIWAGSTPSPLLPTLRALVQAGICMGLYLYLSPMFPLSRFSEPLYYEWGFWHRLFFQYMSGFTARWKYYFIWSISEAAIIISGLGFTGWSDSSPPKAKWDRAINVDILGVELAGSAAQLPLKWNIQVSTWLRYYVYERLIQKGKKPGFLQLLGTQTVSAIWHGLYPGYMIFFVQSALMINGSKVIYRWQQAVGNSGLRTILSLVNCGYTMMVLNYSCIGFQVLSFQETLASYKSVYYVGTIVPILCVLLGYVIKPARPVKPKARKAE

SEQ ID NO: 4471 - protein, 457 aa, Panicum virgatum
MGPEMEAMAASIGVSVPVLRFLLCFAATIPTGLLWRAVPGATGRHLYAGLTGAALSYLSFGATSNLLFVAPMALGYLAMLLCRRRAGLITFLGAFGFLIACHVYYMSGDAWKEGGIDATGALMVLTLKVISCAINYSDGILKEEGLRESQKKYRLTKLPSLIEYFGYCLCWGSHFAGPVYEMKDYLDWTERKGIWASSTPSPLLPTLRAIVQAGICMGLYLYLSPKFPLSRFSEPLYYEWGFWHRLFYQYMSGFTARWKYYFIWSISEAAIIISGLGFTGWSASSPPKAKWDRSKNVDVLGVELAGSAVQLPLVWNIQVSTWLRYYVYERLIQKGKKPGFLQLLGTQTVSAIWHGLYPGYIIFFVQSALMINGSRVIYRWQQAVSNSVLRSILAFLNFAYTLLVLNYSCIGFQVLSFKETLASYQSVYYVGTIVPIVCLLLGNVIKPARKPKAQKAE

SEQ ID NO: 4472 - protein, 460 aa, Triticum aestivum
MGLEMEPMAAAIGVSVPVLRFLLCFAATIPTGLLWRAVPSATGRHLYAGLSGAALSYLSFGATSNLLFVGPMALGYLAMLLCRRRAGLVTFLGAFGFLIACHVYYMSGDAWKEGGIDATGALMVLTLKVISCSMNYSDGLLKEEEGLRDAQKKYRLAKLPSLVEYFGYCLCCGSHFAGPVYEMKDYLEWTERKGIWASSTPSPLLPTLRALVQAGICMGLYLYLSPMFPLSRFSEPLYYEWGFWHRLFFQYMSGFTARWKYYFIWSISEAAIIISGLGFTGWSDSSPPKAKWDRAINVDILGVELAGSAAQLPLKWNIQVSTWLRYYVYERLIQKGKKPGFLQLLGTQTVSAIWHGLYPGYMFFFVQSALMINGSKVIYRWQQAVSNSGLRTILSLLNCAYTMMVLNYSCIGFQVLSFQETLASYKSVYYVGTIVPILCVLLGYVIKPARPVKPKARKAE

SEQ ID NO: 4473 - protein, 460 aa, Triticum aestivum
MGLEMEPMAAAIGVSVPVLRFLLCFAATIPTGLLWRAVPSATGRHLYAGLSGAALSYLSFGATSNLLFVGPMALGYLAMLLCRRRAGLVTFLGAFGFLIACHVYYMSGDAWKEGGIDATGALMVLTLKVISCSMNYSDGLLKEEEGLRDAQKKYRLAKLPSLVEYFGYCLCCGSHFAGPVYEMKDYLEWTERKGIWASSTPSPLLPTLRALVQAGICMGLYLYLSPMFPLSRFSEPLYYEWGFWHRLFFQYMSGFTARWKYYFIWSVSEAAIIISGLGFTGWSDSSPPKAKWDRAINVDILGVELAGSAAQLPLKWNIQVSTWLRYYVYERLIQKGKKPGFLQLLGTQTVSAIWHGLYPGYMFFFVQSALMINGSKVIYRWQQAVSNSGLRTILSLLNCAYTMMVLNYSCIGFQVLSFQETLASYKSVYYVGTIVPILCVLLGYVIKPARPVKPKARKAE

SEQ ID NO: 4474 - protein, 457 aa, Saccharum officinarum
MGLEMEAMAASIGVSVPVLRFLLCFAATIPTGLLWRAVPGATGRHLYAGLTGAALSYISFGATSNLLFVVPMTLGYLAMLLFRRHAGLITFLGAFGFLIACHVYYMSGDAWKEGGIDATGALMVLTLKVISCAINYSDGILMEEGLRDAQKKYRLTKLPSLIEYFGYCLCCGSHFAGPVYEMKDYLEWTERKGIWASPTPSPLLPTLRALVQAGICMGLYLYLSPKFPLSRFSEPLYYEWGFWHRLFYQYMSGFTARWKYYFIWSISEASIIISGLGFTGWSESSPPKAKWDRAKNVDVLGVELAGSAVQLPLVWNIQVSTWLRYYVYERLIQKGKKPGFLQLLGTQTVSAIWHGLYPGYIIFFVQSALMINGSRVIYRWQQAVSSSFLRGILAFLNFAYTLLVLNYSCIGFQVLSFEETLASYKSVYYVGTIVPIVCILLGNVIKPARKAKARKTE

SEQ ID NO: 4475 - protein, 457 aa, Sorghum bicolor
MGLEMEAMAASIGVSVPVLRFLLCFAATIPTGLLWRAVPGATGRHLYAGLTGATLSYLSFGPSSNLLFVVPMTLGYLAMLLSRRHAGLITFLGAFGFLIACHVYYMSGDAWKEGGIDATGALMVLTLKVISCAINYSDGILKEEGLRDAQKKYRLTKLPSLIEYFGYCLCCGSHFAGPVYEMKDYLDWTERKGIWASPTPSPLLPTLRALVQAGVCMGLYLYLSPKFPLSRFSEPLYYEWGFWHRLFYQYMSGFTARWKYYFIWSISEASIIISGLGFTGWSESSPPKAKWDRAKNVDVLGVELAGSAVQIPLVWNIQVSTWLRYYVYERLIQKGKKPGFLQLLGTQTVSAIWHGLYPGYIIFFVQSALMINGSRVIYRWQQAVSSSFLRGILAFLNFAYTLLVLNYSCIGFLVLSFKETLASYQSVYYVGTIVPIVFLLLGNVIKPARKAKARKTE

SEQ ID NO: 4476 - protein, 460 aa, Hordeum vulgare
MGLEMEPMAAAIGVSVPVLRFLLCFAATIPTGLLWRAVPSATGRHLYAGLSGAGLSYLSFGATSNLLFVGPMALGYLAMLLCRRRAGLVTFLGAFGFLIACHVYYMSGDAWKEGGIDATGALMVLTLKVISCSMNYSDGLLKEEEGLRDAQKKYRLTTMPSLVEYFGYCLCCGSHFAGPVYEMKDYLEWTERKGIWASSTPSPLLPTLRALVQAGICMGLYLYLSPMFPLSRFSEPLYYEWGFWHRLFFQYMSGFTARWKYYFIWSVSEAAIIISGLGFTGWSDSSPPKAKWDRAINVDILGVELAGSAAQLPLKWNIQVSTWLRYYVYERLIQKGKKPGFLQLLGTQTVSAIWHGLYPGYMIFFVQSALMINGSKVIYRWQQAVSNSGLRTILSLLNCAYTMMVLNYSCIGFQVLSFQETLASYKSVYYVGTIVPILCVLLGYVIKPARPVKPKARKAE

SEQ ID NO: 4477 - protein, 457 aa, Zea mays
MGLEMEAMAGSIGVSVPVLRFLLCFAATIPTGLLWRAVPGAMGRHLYAGLTGATLSYLSFGATSNLLFVVPMTLGYLAMLLFRRHAGLITFLGAFGFLIACHVYYMSGDAWKEGGIDATGALMVLTLKVISCSINYSDGILKEEGLRDAQKKNRLTKLPSLIEYFGYCLCCGSHFAGPVYEMKDYLEWTERKGIWASPTPSPLLPTLRALVQAGICMGLYLYLSPKFPLSRFSEPLYYEWGFWHRLFYQYMSGFTARWKYYFIWSISEASIIISGLGFTGWSESSPPKAKWDRAKNVDVLGVELAGSSVQLPLVWNIQVSTWLRYYVYERLIQKGKKPGFLQLLGTQTVSAIWHGLYPGYIIFFVQSALMINGSRVIYRWQQAASSSLLSGILAFLNFAYTLLVLNYSCIGFQVLSFKETLASYRSVYYVGTIVPIVCLLLGNVIKPARKAKARKTE

SEQ ID NO: 4478 - protein, 434 aa, Hordeum vulgare
MGLEMEPMAAAIGVSVPVLRFLLCFAATIPTGLLWRAVPSATGRHLYAGLSGAGLSYLSFGATSNLLFVGPMALGYLAMLLCRRRAGLVTFLGAFGFLIACHVYYMSGDAWKEGGIDATGALMVLTLKVISCSMNYSDGLLKEEEGLRDAQKKYRLTTMPSLVEYFGYCLCCGSHFAGPVYEMKDYLEWTERKGIWASSTPSPLLPTLRALVQAGICMGLYLYLSPMFPLSRFSEPLYYEWGFWHRLFFQYMSGFTARWKYYFIWSVSEAAIIISGLGFTGWSDSSPPKAKWDRAINVDILGVELAGSAAQLPLKWNIQVSTWLRYYVYERLIQKGKKPGFLQLLGTQTVSAIWHGLYPGYMIFFVQSALMINGSKVIYRWQQAVSNSGLRTILSLLNCAYTMMVLNYSCIGFQVSFQETLASYKSVYYVGTIV

SEQ ID NO: 4479 - protein, 760 aa, Setaria italica
MVARMMRWPRPPAARKFRVRLVVRRAEGLPLPAPAVEPASPEREAAGAAPPRAVAAEVRWKGPRASALGSLRRAAVRRNRTREEAEAAWEEEFESVVTLAAASQREGAAFQPWELAFCVFSDINIGAKNKPSILGTASLNLADYASAAEEVIEIILPLSVPGGEPESAPSLHLTLSMVELRAVQETSDASQRPAATFPLSPSSGDSLPGGKDEVSVIKAGLRKVKILTDLVATRRSKKTCQDDEGGEDKFCVNSDGAEYPCDTESLDDDLDDRVQEDEIGDSTIRKSFSYGSLQSVNYVGGLVYAHAKIDGEHEDWIYYSHRKSDVGYHVEKMLPSTTEETVLPTAKRSILPWRKRKLSLRSLKAKGEPLLKKAYGEEGGDDIDYDRRLLTSSDQSVSEGSRAEDGSANGMVSEFGDDNFIVGNWEFKEIISRDGHMKLSSQVFFASIDQRSERAAGESACTALVAVIADWFQANRNMMPIQSQFDSLIREGSLEWRNLCENETYRERFPDKHFDLETVLHAKIRPLTVSPSKSFIGFFQPEGDEDMGGFDFLNGAMSFDSIWDEITQAAEFSSSDNPNLYIVSWNDHFFLLKVEHDAYYIIDTLGERLHEGCSQAYILKFDNTTTIHKVQAEKKPSSPDSSGPSKDSSGPESSSTDQDSENDIGEDILVSKGKESCKEYIKSFLAAIPIRELQVDIKKGLMASTPLHHRLQIEFHYTQSSPKEIASAPQLLATDAPFEFSWPEATPTMEVALTPVVSVV

SEQ ID NO: 4480 - protein, 122 aa, Zea mays
MSGSAFNAFKSRVPVAWSPRLYITLVRGLPGTRRLHRRTLEAMRLRRCHRTVEHRTTPSLLGMLTQVKRLVAVETEEMYNARKQAEAERRAPRPPLVVSHQPQPPAPKPAAAAAVGAATTAQ

SEQ ID NO: 4481 - protein, 122 aa, Saccharum officinarum
MSGSAFNAFKSRVPVAWSPRLYITLVRGLPGTRRLHRRTLEAMRLRRCHRTVEHRTTPSLLGMLTQVKRLVAVETEEMYNARKQAEAERRALRPPLVVSHRPPPPTPKPAAAAAEGAAATSQ

SEQ ID NO: 4482 - protein, 123 aa, Zea mays
MSGSAFNAFKSRVPVAWSPRLYITLVRGLPGTRRLHRRTLEAMRLRRCHRTVEHRTTPSLLGMLTQVKRLVAVETEEMYNARKQAEAERRAPRPPLVVSHHQPPPPALKPAAAAAEGAAATAP

SEQ ID NO: 4483 - protein, 122 aa, Setaria italica
MSGSAFNAFKSRVPVAWSPRLYITLVRGLPGTRRLHRRTLEAMRLRRCHRTVEHRTTPSLLGMLTQVKRLVVVETEEMYNARRQAEEERRAPRPPLVISHHPPAPTPKPAAAAAEGAAATAQ

SEQ ID NO: 4484 - protein, 112 aa, Pennisetum glaucum
MSGSAFNAFKSRVPVAWSPRLYITLVRGLPGTRRLHRRTLEAMRLRRCHRTVEHRTTPSLLGMLTQVKRLVVVETEEMYNARRQAEEERRAPRPPLVISHHPPAPTPKPAAA

SEQ ID NO: 4485 - protein, 122 aa, Panicum virgatum
MSGTAFNAFKSRVPVAWSPRLYITLVRGLPGTRRLHRRTLEAMRLRRCHRTVEHRTTPSLLGMLTQVKRLVVVETEEMYNARRQAEEERRAPRPPLLISHHQPAPTANPGAATAEGSAATSP

SEQ ID NO: 4486 - protein, 116 aa, Triticum aestivum
MSGSAFNAFKSRVPVAWSPKLYITLVRGLPGTRKLHRRTLEAMRLRRCHRTVEHRTTPSLLGMLTQVKRLVVVETEEMYNARKQADEQRRALRPPLVVSHAPPPKPAAAAPEGAGQ

SEQ ID NO: 4487 - protein, 115 aa, Secale cereale
MSGSAFNAFKSRVPVAWSPKLYITLVRGLPGTRKLHRRTLEAMRLRRCHRTVEHRTTPSLLGMLTQVKRLVVVETEEMYNARKQADEQRRALRPPLVVSHAPQPKPAAAPEGAGQ

SEQ ID NO: 4488 - protein, 116 aa, Hordeum vulgare
MSGSAFTAFKSKVPVAWSPRLYITLVRGLPGTRKLHRRTLEAMRLRRCHRTVEHRTTPSLLGMLTQVKRLVVVETQEMYNARKQADEQRRALRPPLVVSHAPPPKPAAAAPEGAGP

SEQ ID NO: 4489 - protein, 116 aa, Hordeum vulgare
MSGSAFTAFKSKVPVAWSPRLYITLVRGLPGTRKLHRRTLEAMRLRRCHRTVEHRTTPSLLGMLTQVKRLVVVETQEMYNARKQADEQRRALRPPLVVSHAPPPKPAAAAPEGAGQ

SEQ ID NO: 4490 - protein, 116 aa, Hordeum vulgare
MSGSAFTAFKSKVPVAWSPRLYITLVRGLPGTRKLHRRTLEAMRLRRCHRTVEHRTTPSLLGMLTQVKRLVVVETQEMYNARKQADEQRRALRPPLVVSHAPPSKPAAAAPEGAGQ

SEQ ID NO: 4491 - protein, 112 aa, Setaria italica
MSGSAFNALKSRVPVAWSPRLYITLVRGLPGTRRLHRRTLEAMRLRRCHRTVEHRTTPSLLRMLTQVKRLVVVETEEMYNARRQAEEERRAPRPPLVISCGGGCRCHCAVAS

SEQ ID NO: 4492 - protein, 114 aa, Brachypodium distachyon
MSGSAFNAFKSRVPVEWSPRLYITLVRGLPGTRKLHRRTLEAMRLRRCHRTVEHRTTPSLLGMLTQVKRLVVVETEEMYNARRQADELRRAPRPPLVVSHNPPPKVAASPEAAS

SEQ ID NO: 4493 - protein, 282 aa, Saccharum officinarum
MAAAGSSPSSSSSKRLEGKVALVTGGATGIGEAIVRLFMEHGAKVCIADIQDEAGQQLRDALGGDGEGVMFVHCDVTSEEDVSRAVDAAAERFGALDVMVNNAGVTGTKVTDIRAVDFAEARRVLDVNVHGVFLGMKHAARVMIPQKRGSIVSLASVASAIGGMGPHAYTASKHAVVGLTKSVAAELGRHGVRVNCVSPYAVPTALSMPHLPQGARADDALRDFLAFVGGEANLKGVDAMPKDVAQAVLYLASDEARYVSALNLMVDGGFTAVNHNLRPFDD

SEQ ID NO: 4494 - protein, 281 aa, Setaria italica
MSAASSSPSSSSSAKRLEGKVALVTGGATGIGEAIVRLFREHGAKICIADIQDEAGQQLRDALGDQDVMFVHCDVTVEDEVSAAVDAVAQRFGSLDVMVNNAGITGSKVTDIRNVDFAEVRKVFDINVHGVFLGMKHAARVMIPQKRGSIVSLASVASVIGGMGPHAYTASKHAVAGLTKSVAGELGRHGVRVNCVSPYAVPTALSMPHLPQGARADDALKDFLAFVGGEANLKGVDLMPRDVAEAVLYLASDEARYVSALNLTVDGGFTAVNHNLKPFED

SEQ ID NO: 4495 - protein, 273 aa, Panicum virgatum
  misc_feature (97)..(97): Xaa can be any naturally occurring amino acid
  misc_feature (117)..(117): Xaa can be any naturally occurring amino acid
  misc_feature (137)..(137): Xaa can be any naturally occurring amino acid
  misc_feature (140)..(140): Xaa can be any naturally occurring amino acid
  misc_feature (144)..(144): Xaa can be any naturally occurring amino acid
  misc_feature (146)..(147): Xaa can be any naturally occurring amino acid
  misc_feature (151)..(151): Xaa can be any naturally occurring amino acid
  misc_feature (154)..(154): Xaa can be any naturally occurring amino acid
  misc_feature (169)..(170): Xaa can be any naturally occurring amino acid
  misc_feature (209)..(209): Xaa can be any naturally occurring amino acid
  misc_feature (224)..(224): Xaa can be any naturally occurring amino acid
MSAAGSSPSAASSSKRLEGKAALVTGGATGIGEAIVRLFREHGAKVCIADIQDDAGQRLRDALGDQDVMFVHCDVTVEEDVSATVDAAAKRFGALDXMVNNAGITGTRSRHPQRGLXRGAQGVRHQRARRVPRDEAXGAXHDPXEXXLHRXAGXRGQRHRRDGPARVHXXQARRGWAHQERRRGARAPWGARQLRVALRRAHGAVHAAXAPGRARRRRAQGLLXFVGGEANLKGVDVMPRDVRRGGALPGKRRGEVRQRAQPHGGRRLHSREP

SEQ ID NO: 4496 - protein, 281 aa, Cenchrus ciliaris
MSGASSSPSASSSAQRLEGKVALVTGGATGIGEAIVRLFREHGAKVCIADIQDEAGQKLRDALGDQDVMFVHCDVTVEDEVSAAVDAVAQRFGGLDVMVNNAGITGNKVTDIRNVDSAEVRKVFDINVHGVFLGMKHAARVMIPQKRGSIVSLASVSSVLGGMGPHGYTASKHAVVGLTKSVAAELGRHGVRVNCVSPYAVPTALSMPHLPKGERADDALKDFLAFVGGEANLKGVDAMPKDVAEAVLYLASDEARYVSALNLTVDGGFTAVNRNLKPFED

SEQ ID NO: 4497 - protein, 282 aa, Setaria italica
MSAAASSPSSSSMTKRLEGKVALVTGGASGIGETIVRLFKNHGAKVCIADIQDEAGQKLRDALGGGDDVMFVHCDVTVEEDVSAAVDAVAQRFGALDVMVNNAGITGSKVTDIRNVDFAEVRKVFDINVHGVFMGMKHAARVMIPRKRGSIVSLASVASVIGGMGPHAYTASKHAVAGLTKSVAGELGRHGVRVNCVSPYAVPTALSMPHLPKGARADDAVKDFLAFAGGAANLKGVDLMPEDVAEAVLYLASDEAKYVSALNLVVDGGFTSVNHDMKQFED

SEQ ID NO: 4498 - protein, 866 aa, Setaria italica
MDESGEASVGAFRIGPSTLLGRGVALRVLLFSSLWRLRARAYAAISRVRTTTVPAVASWLHLRNTHGVLLMVVLFALFLRKLSGARSRAALARRRSLCEKAMRHAGTYEEWVRAAKVLDKMSEQVHEADFYDEELIRSRLEELRRRREDRSLRDVVFCMRGDLVRNLGNMCNPELHKGRLEVPKLIKEYIDEVSTQLKMVCESDADELLLEEKLAFVQETRHSFGRTALLLSGGASLGSFHVGVVKTLVEHKLLPRIIAGSSVGSIICSIVATRTWPEIESYFIDSLQTLQFFDRIGGIFAVMKRVTTYGALHDISQMQRLLRDLTSNLTFQEAYDMTGRVLGITVCSPRKNEPPRCLNYLTAPHVVIWSAVTASCAFPGLFEAQELMAKDRFGNIVPFHAPFSTDPEQGPGASKRRWRDGSLEMDLPMMRLKELFNVNHFIVSQTNPHISPLLRMKELVRAYGGRFAGKLARLAEMEVKYRCNQILELGLPMGGLAKLFAQDWEGDVTMVMPATVAQYLKIIQNPTYAELQMAANQGRRCTWEKLSAIRANCAIELALDESIAVLNHKRRLKRSIERTAASQGHSNYVRLKTPRRVPSWNRISRENSSESLSEEISAVATSSTQQGTVLVVGTPPSESLSEEISAVATSSTQQGTVLVVGTPNTSHHVRRNSHDGSESESETIDLNCWTRSGGPLMRTASADKFISFIQNLETDTDFIKPCTLEGETTGILSESTFPNDPCPNNSSRVTTPGTEISETESYNTVNTRGSQASTPTSIAVSEGDLLQPESTANGILLNIVKRDALHAQHDSVAELAERSLAEAYVEPCGAISGSDSTEDSKDAADSSNPSPDNADSVTSHQFSADD

SEQ ID NO: 4499 - protein, 283 aa, Brachypodium distachyon
MSAAAAVSSSSSPRRLEGKVALVTGGASGIGEAIVRLFRQHGAKVCIADVQDEAGQQVRDSLGDDAGTDVLFVHCDVTVEEDVSRAVDAAAEKFGTLDIMVNNAGITGDKVTDIRNLDFAEVRKVFDINVHGMLLGMKHAARVMIPGKKGSIVSLASVASVMGGMGPHAYTASKHAVVGLTKSVALELGKHGIRVNCVSPYAVPTALSMPHLPQGEHKGDAVRDFLAFVGGEANLKGVDLLPKDVAQAVLYLASDEARYISALNLVVDGGFTSVNPNLKAFED

SEQ ID NO: 4500 - protein, 244 aa, Zea mays
MEHGAKVCIADIQDEAGQQLRDALGGDAQGAMFVHCDVTSEEDVSRAVDAAAERFGALDVMVNNAGVTGTKVTDIRNVDFAEARRVLDVNVHGVFLGMKHAARAMIPRKRGSIVSLASVASAIGGTGPHVYTASKHAVVGLTKSVAAELGRHGVRVNCVSPYAVPTALSMPHLPQGARADDALKDFLAFVGGEANLKGVDAMPEDVAQAVLYLASDEARYVSAVNLMVDGGFTAVNNNLRAFED

SEQ ID NO: 4501 - protein, 737 aa, Triticum aestivum
AKVLDRMSDQVNESDFYDVELIGSRLDELRRRREEGSLRDVVFCMRGDLVRNLGNMCNPELHKGRLEVPRLIKDFIDEVSTQLKMVCESDTDELLLEEKLAFVQETRHAFGRTALLLSGGASLGSFHVGVVKTLVEHKLLPRIVAGSSVGSIICSIVATRTWPEIESFFIDSLQILKFFDRIGGVFAVTKRVMTYGALHDISQMQRLLRDLTSNLTFQEAYDITGRVLGVTVCSPRKNEPPRCLNYLTSPHVVIWSAVTASCAFPGLFEAQELMAKDRFGHIVPFHAPFATDPEQGPGASKRRWRDGSLEMDLPMMQLKELFNVNHFIVSQTNPHISPLLRMKEIVRAYGGRFAGKLARLAEMEVKYRCNQVLEIGLPLGGLAKLFAQDWEGDVTMVMPATVAQYLKIIQNPTYPELQMAANQGRRCTWEKISAIRANCAIELALDESIAALNHKRRLRRSIERAAASSQGYTDNVRVKTPRRVPSWSCISRENSSGSLSEDHFAAAISSNHQGTIRVDGAPSTSHHVRHRSHDGSESESETIDLNSWTRSGGPLMRTSSADQFINFIQNLEIESEFDGVHTIEGGNAGIFTGPTFPRDPYPTNISRATTPDGPDRCTEVSETESCNSTSNVSIAVSEGDLLQPGRTTNGILLNFVRREDLIARHNGDADVAESSLPQAYVDRTHSESGDAISAASDSSEDNKDVADSDNPSVSHTDFVTPPQPSVDDNEDAKLDFK

SEQ ID NO: 4502 - protein, 283 aa, Triticum aestivum
MSAAAGGSSSSSTSAPRLEGKVALVTGGASGIGEAIVRLFRQHGAKVCIADVQDEAGQQLRDSLGGDPDVLFVHCDVTVEEDISRAVDATAEKFGTLDIMVNNAGITGDKVTDIRNLDFADVKKVFDINVHGMLLGMKHAARVMIPSKKGSIVSLASVASVIGGMGPHAYTASKHAVVGLTKSVALELGRHGIRVNCVSPYAVPTALSMPHLPQGEQKGDAVRDFLAFVGSEANLKGVDLLPKDVAEAVLYLASDEARYISALNLVVDGGFTSVNGNLKAFED

SEQ ID NO: 4503 - protein, 281 aa, Pseudoroegneria spicata
MSFAAGSSSSSSAPRLEGKVALVTGGASGIGEAIVRLFRQHGAKVCIADVQDETGQQLCDSLGGNPDVLFVHCDVTVEEDISRAVDATAEKFGTLDIMVNNAGITGDKVTDIRNLDFADVKKVFDINVHGMLLGMKHAARVMIPSKKGSIVSLASVASVIGGMGPHAYTASKHAVVGLTKSVALELGRHGIRVNCVSPYAVPTALSMPHLPQGEHKGDAVRDFLAFVGSEANLKGVDLLPKDVAEAVLYLASDEARYISALNLVVDGGFTSVNRNLKAFED

SEQ ID NO: 4504 - protein, 145 aa, Zea mays
MSPASSMLTAVSLSSPLPAPRLRAAAAASSFAPPRRAAVALVVRAASASSKSPATAEAAPKKKRATGITQPKSVSPALQAIVGDPVIPRTEVLKRLWAYIKEHNLQDPSDKKVVVCDEKLKVLFAGRERVGFLEIAKLLNPHFVK

SEQ ID NO: 4505 - protein, 392 aa, Zea mays
MTSCFNSGAGWPEPVVRVQAVSDTCGDTIPERYVKPLPERPRLSPASDVGGGRNIPVIDLSMPDVDATSRAVAAACREWGFFQAVNHGVRPELLRGARAAWRGFFKQPAEVRERYANSPSTYEGYGSRLGTAKGGPLDWGDYYFLHLLPSSLKNHEKWPSLPYSLRGTTEEYGEEVLHLCRRVMRLLSSGLGLEAGRLQAAFGGEGGEGACLRINFYPRCPQPELTLGVAGHSDPGGMTMLLVDDHVKGLQVRGPDGQWIIVDPVPDAFIVNIGDQIQVLSNAAYKSVEHRVTVSATEDRLSMAFFYNPRSDLPIAPMAELVGPGRPALYPEMTFDEYRVFIRQRGLAGKAQLESMQKAAATAADGGRRQLVHQLAATEHIISRASWSVSDA

SEQ ID NO: 4506 - protein, 385 aa, Zea mays
MSRLLLLGAAVLLLASAATAQDCLSATFSGGRTFGRCNNLPSLSASLHWTYHPENGTADVAFRAPSDASGWVAWGINPDRGGSMGGSSVFVASPSQDGSGAVSILMTHLESTSPSLTNNTLKFKVPVGPAAEYSNGAYTIFATVELPGNSTQQFTVWQAGATSNGAISPHPTAPANLASTQRLDFLSGSSTAASNSRLHRRNIHGMLNAIAWGVLIPVGAIIARYLRVFESADPAWFYLHIACQCSGYILGVAGWGLGLKLGSESAGVTYQPHRSIGIAIFCLATLQVFALLLRPDKKNRYRLYWNIYHHSVGYSVIVLGAVNIFKGLDILKPDSGYKTAYIVVLATLGGVALCLEAITWPIAIRKRRRNAADKASNGNGWQQGA

SEQ ID NO: 4507 - protein, 386 aa, Zea mays
MARLLLLLLGASVLLLASAVTAQDCLSATFSGGRTFGKCNSLPSLSASLHWTYHPENGTADVAFRAPSDPSGWVAWGINPDSGGSMEGSSVFVASQDGSGAVSILMTNLESTSPSLTNTTALKFKVPAGPAAEYSDRAYTIYATVELPRNSTQQFTVWQAGPATSNGGISPHPTAPANLASTQRLDFLSGSSTAASNSKLHRRNIHGMLNAIAWGVLIPTGAIIARYLRVFESADPAWFYLHIACQCSGYVLGVAGWGLGLKLGSESAGVTYQPHRSIGIAIFCLATLQVLALLLRPDKKNKYRLYWNIYHHSVGYAVIVLSAVNIFKGLHILEPASGYKTAYIVILATLAGIALCLEAITWPIAIRKRRRNADKASGGNGWQQGA

SEQ ID NO: 4508 - protein, 361 aa, Saccharum officinarum
MWVTQVWDDEAAGKGGGAAVTPAPAAAMLGSLAGWLSRTVQPQPPPPRVCGTEGGPPVTAPRLRLRDGRHLAYCESGVPRDQARFKVVFSHGFTGSREDSVRASQEVAEELGVYMVGFDRAGYGQSDPNPNRSVKSAALDVEELADALGLGPKFYVIGISLGCHAVWGALKYIPDRIAGAAMMAPVVNYWWPGFPAELAAEVYAKQEVGDQWALRVSHHAPGILHWWMEQSWLPTSTVVAGTTPLPNARDAEIRRNMQADGTFQQKREQATQQGIHESYYRDMTVMFGKWEFDPMALPEPPCPVHLWQGDEDGLVPVVLQRYLAGKLAWVNYHELPGTGHFLSAVPGLGDTVLRTLFGQKQ

SEQ ID NO: 4509 - protein, 362 aa, Panicum virgatum
MWVTSMPQVWDEEGVPKRGAADAVTPAPAAAMLSSLAGWLSRTVQPQPPPPRVCGTDGGPPVTAPRLRLRDGRHLAYCETGVPKDKARFKVVFSHGFTGSREDTVRPSQEVAEELGVYMVGFDRAGYGQSDPNPNRSVKSAALDVEELADALGLGPKFYLIGISLGCHAVWGALKYIPDRIAGAAMMAPVVNYWWPGFPADLAAEVYAKQEVGDQWALRVSHHAPGILHWWMEQSWLPTSTVVAGTTPLPNKRDAEIRSNMKADGTFQQRMEQATQQGIHESYYRDMMVMFGKWEFDPMSLPQPPCPVHLWQGDEDGLVPVVLQRYLAGRLTWINYHELPGTGHFLSSVPGLGDTVLRTLFA

SEQ ID NO: 4510 - protein, 357 aa, Panicum virgatum
MWVTSMPQVWDEEGGADAVTPAPAAAMLSSLSGWLSRTVQPQPPAPRVCGTEGGPPVTATRLRLRDGRHLAYCETGVPKDKARFRVVFSHGFTGSREDTVRPSQEVAEELGVYMVGFDRAGYGQSDPNPKRSVKSAALDVEELADALGLGPKFYLIGISLGCHAVWGALKYIPDRIAGAAMMAPVVNYWWPGFPADLAAEVYAKQEVGDQWALRVSHHAPGILHWWMEQSWLPTSTVVAGTTPLPNKLDAEMRSKMMADGTFQQRKEQATQQGIHESYYRDMMVMFGKWEFDPMSLPQPACPVHLWQGDEDGLVPVVLQRYLASRLSWVNYHELPGTGHFLSSVPGLGDTVLRTLFG

SEQ ID NO: 4511 - protein, 357 aa, Oryza sativa
MWVTSMPQVWDEEGVAKGSVVTPAPATALLGSLAGWMSRAVEPPAPRPCGTEGGPPVTATRLRLRDGRHLAYCESGVPKEEARFKVVFSHGFTGSREDSVRASQEVAEELGVYMVGFDRAGYGESDPNPNRSVKSAALDVEELADALGLGPKFYVIGISLGCHAVWGALKYIPERIAGAAMMAPVVNYWWPGFPTDLAAEVYNKQEVGDQWALRVSHHAPSILHWWMEQSWLPTSTVVAGTTPLPNKRDAEIRKNMKADGSFQKKMDLATQQGIHESYYRDMMVMFGKWEFDPMSLPKPPCPVHIWQGDEDGLVPVVLQRYLVSRLSWANYHELPGTGHFLSAVPGLGDTVLRTIFG

SEQ ID NO: 4512 - protein, 363 aa, Secale cereale
MWVTSMPQVWDEEARSRKGDGIMSPAPAAAMLGSLAGWLSRAADPPAPKLCGSPGGPPVTAPRVALRDGRHLAYCESGVPKEQARFKVVFSHGFTGSREDSVRAAQEVAEELGVYMVGFDRAGYGESDPNPNRSVKSAALDVEELADALGLGPKFYVIGISLGCHAVWGALKYIPERIAGAAMMAPVVNYWWPGFPADLTAEVYSKQEVGDQWALRVSHYAPGILHWWMDQSWLPTSTVVAGTTPLPNKRDAEIRAKLKADGTFQQKMELATQQGIHESYYRDMMVMFGKWDFDPMSLPKPPCPVHIWQGDEDGLVPVVLQRHIASRLSWVNYHELPETGHFLSPVPGLGDTVLRTLFGNAKQ

SEQ ID NO: 4513 - protein, 363 aa, Triticum aestivum
MWVTSMPQVWDEEARSRKGDDMMSPAPAAAMLGSLAGWLSRAADPPAPKLCGSPGGPPVTAPRVALRDGRHLAYCESGVPKEQARFRVVFSHGFTGSREDSVRATQEVAEELGVYMVGFDRAGYGESDPNPNRSVKSAALDVEELADALGLGPKFYVIGISLGCHAVWGALKYIPERIAGAAMMAPVVNYWWPGFPADLAAEVYNKQEVGDQWALRVSHYAPGILHWWMDQSWLPTSTVVAGTTPLPNKRDAEIRAKLKADGTFQQKMELATQQGIHESYYRDMMVMFGKWEFDPMSLPKPPCPVHIWQGDEDGLVPVVLQRHIASRLSWVNYHELPATGHFLSPVPGLGDTVLQTLFGNAKQ

SEQ ID NO: 4514 - protein, 363 aa, Secale cereale
MWVTSMPQVWDEEARSRKVDGIMSPAPAAAMLGSLAGWLSRAADPPAPKLCGSPGGPPVTAPRVALRDGRHLAYCESGVPKELARFKVVFSHGFTGSREDSVRATQEVAEELGVYMVGFDRAGYGESDPNPNRSVKSAALDVEELADALGLGPKFYVIGISLGCHAVWGALKYIPERIAGAAMMAPVVNYWWPGFPADLTAEVYSKQEVGDQWALRVSHYAPGILHWWMDQSWLPTSTVVAGTTPLPNKRDAEIRAKLKADGTFQQKMELATQQGIHESYYRDMMVMFGKWDFDPMSLPKPPCPVHIWQGDEDGLVPVVLQRHIASRLSWVNYHELPETGHFLSPVPGLGDTVLRTLFGNAKQ

SEQ ID NO: 4515 - protein, 364 aa, Triticum aestivum
MWVTSMPQVWDEEARSRKGDGDMMSPAPAAAMLGSLAGWLSRAADPPAPKLCGSPGGPPVTAPRVTLRDGRHLAYCESGVPKEQARFRVVFSHGFTGSREDSVRATQEVAEELGVYMVGFDRAGYGESDPNPNRSVKSAALDVEELADALGLGPKFYVIGISLGCHAVWGALKYIPERIAGAAMMAPVVNYWWPGFPADLAAEVYKKQEVGDQWALRVSHYAPGILHWWMDQSWLPTSTVVAGTTPLPNKRDAEIRAKLKADGTFQQKMELATQQGIHESYYRDMMVMFGKWEFDPMSLPKPPCPVHIWQGDEDGLVPVVLQRHIVSRLSWVNYHELPATGHFLSPVPGLGDTVLQTLFGNAKQ

SEQ ID NO: 4516 - protein, 364 aa, Triticum aestivum
MWVTSMPQVWDEEARSRKGDGDMMSPAPAAAMLGSLAGWLSRAADPPAPKLCGSPGGPPVTAPRVALRDGRRLAYCESGAPKERARFRVVFSHGFTGSREDSVRATQEVAEELGVYMVGFDRAGYGESDPNPNRSVKSAALDVEELADALGLGPKFYVIGISLGCHAVWGALKYIPERIAGAAMMAPVVNYWWPGFPADLAAEVYNKQEVGDQWALRVSHYAPGILHWWMDQSWLPTSTVVAGTTPLPNKRDAEIRAKLKADGTFQQKMELATQQGIHESYYRDMMVMFGKWEFDPMSLPKPACPVHIWQGDEDGLVPVVLQRHIASRLSWVNYHELPATGHFLSPVPGLGDTVLQTLFGNAKQ

SEQ ID NO: 4517 - protein, 355 aa, Brachypodium distachyon
MWVTSMPQVWDEEARSRGGGSGMAASPAAALLGWLSRAADPPAPKPCGSPGGPPVTAPRVTLKDGRRLAYCESGVPKEQARFKVVFSHGFTGSREDSVRATQEVAEELGVYMVGFDRAGYGESDPNPNRSVKSAALDVEELADALGLGSKFYVIGISLGCHAVWGALKYIPDRIAGAAMMAPVVNYWWPGFPADLAAEVYNKQEVGDQWALRVSHHAPGILHWWMEQSWLPTSTVIAGTTPLPNKRDAEIRSNMKADGTFQKKMELATQQGIHESYYRDMMVMFGKWEFDPMSLPKPPCPVHIWQGDEDGLVPVVLQRHLASQLSWVNYHELPGVGHFMSPVPGLGDTVLRTLFG

SEQ ID NO: 4518 - protein, 175 aa, Setaria italica
MWVTSMPQVWDEEGAAKGAADAVTPAPAAAMLGSLAAWLSRTIQPQPPAPRVCGTEGGPPVTAPRVRLRDGRYCETGVPKEQARFKVVFSHGFTGSREDSVRPSQEVAEELGVYMVGFDRAGYGQSDPNPNRSVKSAALDVEELADALGLGPKFYVIGISLGCHAVWGALKYIPD

SEQ ID NO: 4519 - protein, 342 aa, Avena sativa
GAAGMVTPAPATALLGSLAGWLSRVADPPAAKVCGAPGGPPVTAPRVTLRDGRHLAYCESGVPKEQARFKVVFSHGFTGSREDSVRASQEVAEELGVYMVGFDRAGYGESDPNPNRSVKSAALDVEELADALGLGPKFYVIGISLGCHAVWGALKYIPDRIAGAAMMAPVVNHWWPGFPADLAAEVYNRQEVGDQWALRVSHHAPGILHWWMDQTWLPTSTVVAGTTPLPNKRDSEIRTKLKADGTFQQKMELATQQGIHESYYRDMMVMFGKWEFDPMSLPKPTCPVHIWQGDEDGLVPVVLQRHIASRLSWVNYHELSETGHFLSPVPGLGDTVLRTLFS

SEQ ID NO: 4520 - protein, 354 aa, Setaria italica
MELLAKAPVLGCAGKRQLGAPVGSVVGALGRWISGAVPPPPPPRVCGTPGGPPVTAPRVRLRDGRHLAYAESGARKEDARFKVVISHGFTGSRLDTIRAAPEVAEELGVYMVGFDRAGYGQSDPNPNRSVKSAALDVEELADALGLGPKFYVIGISLGCHAVWGALKYIPDRIAGAAMMAPVVNYWWPGFPADLVAEVYAKQEVGDQWALRVSHHAPGILHWWMEQSWLPTSTVVAGTTPLPNKRDAEIRSKMKEDGTFQQKMEQATQQGIHESYYRDMMVMFGKWEFDPMSLPEPPCPVHLWQGDEDGLVPVVLQRYLASRLSWLNYHELPGTGHFLSPVPGLGDTVLRTLFG

SEQ ID NO: 4521 - protein, 338 aa, Avena sativa
MVTPAPATALLGSLAGWLSRVADPPAAKVCGAPGGPPVTAPRVTLRDGRHLAYCESGVPKEQARFKVVFSHGFTGSREDSVRASQEVAEELGVYMVGFDRAGYGESDPNPNRSVKSAALDVEELADALGLGPKFYVIGISLGCHAVWGALKYIPDRIAGAAMMAPVVNHWWPGFPADLAAEVYNRQEVGDQWALRVSHHAPGILHWWMDQTWLPTSTVVAGTTPLPNKRDSEIRTKLKADGTFQQKMELATQQGIHESYYRDMMVMFGKWEFDPMSLPKPTCPVHIWQGDEDGLVPVVLQRHIASRLSWVNYHELSETGHFLSPVPGLGDTVLRTLFS

SEQ ID NO: 4522 - protein, 238 aa, Sorghum bicolor
MSPPPSPLVVLPLLLLLAAVSHFAANVAGAGAPPPVPTPWPEQFHAVVFTNLTESGGRLQLIDLYYDWPRGRNLNLIRDQLSGDPLYDVEWTNGTSYFFDSGSCRTVRVPVGLLPPDWLAAGAVYLGREHVDGFDCHLWTKVDFIWYYEEVATGRPVRWNFFNGMQQHVMSFEVGGVLEDSKWQAPAYCFNGGNADTANVAADGVDSDAGRSSRVDVDVMNSLIRFAGAPAVAASFDQ

SEQ ID NO: 4523 - protein, 238 aa, Zea mays
MSPPPSSLVVLPLLLPLLLAAVSHATANAAGAGAPPPVPTPWPEQFHAVVFTNLTESGGRLQLIDLYYDWPRGRNLNLIRDQLSSDPLYDVEWTNGTSYFFDSGSCRTMRFPVGILPPDWLAAGAVYLGREHVDGFDCHLWTKVDFVWYYEEVATGRPVRWNFFNGMQQHVMSFEVGGVLEDSKWQAPPRCFSGGNADTANAAADGVHGEEAGSVDVMDSMIRFAVAPAAAVAASFDQ

SEQ ID NO: 4524 - protein, 216 aa, Panicum virgatum
  misc_feature (15)..(15): Xaa can be any naturally occurring amino acid
  misc_feature (72)..(72): Xaa can be any naturally occurring amino acid
MLLPLLLLLAAGSFXAANAKPGAPAPVPTPWPEQFHAVVFTNLTESGGRLQLIDLYYDWPKGRNLNLIQNQXSGDPTYDVEWTNGTSYYFDSGSCRTMRFPVGLLPPDWLADGAVYLGREHVDGFDCHLWTKVDFIWYYEEVATGRPVRWNFFNGMQQHVMSFEVGGVLEDSMWQAPAYCFNADTANLAADGVDVMNSLMRFAGAPAAAIAASFDQ

SEQ ID NO: 4525 - protein, 387 aa, Saccharum officinarum
MGSEGRAWNGAAGSGHGGGVEAKAITAAVSAAEVPRLAVSVDISLPLPEMSPDIIFLCKELVSGWCKIDSSRFSIETVSGGITNLLLKVSVKEDNGNESSVTVRLYGPNTDLVIDRKRELQAIPYLSAAGFGARLLGIFENGVVQSFIYARTLSPADMRDPKIAAEIAKELRKFHQVDIPGSKKPQLWNDIFKFLKKAAALKFEDNEQQKTYEKISFREIQDEVQELKDLLDILNAPVVYAHNDLLSGNLMLNDLEGKLYFIDFEYGSYSYRGYDIANHFNEYAGFDCDYNLYPDKDAQYHFFRNYLRPDRPSEAQAQDMEVLYVETNTFRLASHIYWALWALIQAKVSPIDFDYLGYFFLRYGEYKKQRESCFSLAQSFLSELRNG

SEQ ID NO: 4526 - protein, 393 aa, Zea mays
MGSEGRAWNGAGMAAGSGYGGGVEAKATTTAVSAAAPAEVPTSAASVDISLPLLKMSPRIIALCKELVEGWSSIDSSLFSIETVSGGITNLLLKVSVKEDNGNESSVTVRLYGPNTDLVIDRKRELQAIPYLSAAGFGARLLGIFENGVVQSFIYARTLSPADMKEPKIAAEIAKELRKFHQVDIPGSKEPQLWNDIFKFLKKAAALKFEDNMKQKRYEKISFREIQDEVQELKDLLDILRAPVVYAHNDLLSGNLMLNDLEGKLYFIDFEYGSYSYRGYDIANHFNEYAGFDCDYNLYPDKDAQYHFFRNYLHTDRPSEVDAQDMEVLYVETNTFRLASHIYWALWALIQAKVSPIDFDYLGYFFLRYGEYKKQRESCFSLAQSFLSELKNG

SEQ ID NO: 4527 - protein, 389 aa, Panicum virgatum
MGSEGRGWNGAGDGARGGEEKPTTTAAVAAGAPADVPTSAASVDISLPLPEMTPHIIGLCKGSVKGWSSLDSSCFSIETVSGGITNLLLKVSVKEDTGNEFSVTVRLYGPNTDLVIDRKRELQAIPYLSAAGFGARLLGIFENGVVQSFIHARTLSPADMREPRIAAEIAKELHRFHQVDIPGSKEPQLWNDIFKFLKKASALKFEDNEKRKRYETISFREIQDEVKELKDLSDLLRAPVVFAHNDLLSGNLMLNDSEGKLYFIDFEYGSYSYRGYDIANHFNEYAGFDCDYNMYPDKDAQYHFFRNYMQPDRPSEVQAQDLEALYVETNTFRLASHIYWALWALIQAKVSPIDFDYLGYFFQRYGEYKKQRESCFSLAQSFLSELRNG

SEQ ID NO: 4528 - protein, 393 aa, Setaria italica
MGSEGRGWNGAAAGSGDGVGGREEKPTTTAAVAAGAPADVPTSAASVDITLPLPEMTPRIIGLCKELVKGWSSLDSSCFSIETVSGGITNLLLKVSVKEDTDNEFSVTVRLYGPNTDLVIDRKRELQAIPYLSAAGFGARLLGIFENGVVQSFINARTLSPADMREPRIAAEIAKELHRFHQVDIPGPKEPQLWDDIFKFLKKASALKFKDNEKQKRYETISFTEIQDEVQELKDLSDLLHAPLVFAHNDLLSGNLMLNDSEGKLYFIDFEYGSYSYRGYDIANHFNEYAGFDCDYNMYPDKDVQYHFFRNYLQPDKPSEVRAQDLEALYVETNTFRLASHIYWALWALIQANVSPIDFDYLGYFFLRYGEYKKQRESCISLAQGFLSELRNG

SEQ ID NO: 4529 - protein, 392 aa, Setaria italica
GSEGRGWNGAAAGSGDGVGGREEKPTTTAAVAAGAPADVPTSAASVDITLPLPEMTPRIIGLCKELVKGWSSLDSSCFSIETVSGGITNLLLKVSVKEDTDNEFSVTVRLYGPNTDLVIDRKRELQAIPYLSAAGFGARLLGIFENGVVQSFINARTLSPADMREPRIAAEIAKELHRFHQVDIPGPKEPQLWDDIFKFLKKASALKFKDNEKQKRYETISFTEIQDEVQELKDLSDLLHAPLVFAHNDLLSGNLMLNDSEGKLYFIDFEYGSYSYRGYDIANHFNEYAGFDCDYNMYPDKDVQYHFFRNYLQPDKPSEVRAQDLEALYVETNTFRLASHIYWALWALIQANVSPIDFDYLGYFFLRYGEYKKQRESCISLAQGFLSELRNG

SEQ ID NO: 4530 - protein, 527 aa, Setaria italica
MAGGVVVNTGGGKDYPGKLTMFVLFACIVAATGGLIFGYDIGISGGVTSMNPFLMKFFPSVYRKEQEAERNQTNQYCKFDSQLLTMFTSSLYLAALVASFFAATVTRVAGRKWSMFGGGVTFLIGAALNGAAKDVVMLILGRVLLGIGVGFANQAVPVYLSEMAPARLRGMLNIGFQLMITIGILCANLINYGTAKIKGGWGWRVSLALAAVPAAIIAIGALFLPDTPNSLIDRGYTDAAKRMLKRVRGTEDVEEEYNDLVAASEESKLVAHPWRNILQPRYRPQLVMAIAIPMFQQLTGINVIMFYAPVLFKTLGFADDASLMSAVITGLVNVFATFVSIVTVDRLGRRKLFLQGGTQMLACQIVVGSLIGAKFGFSGVAEIPKAYAAIVVLFICAYVAGFAWSWGPLGWLVPSEIFPLEIRSAGQSINVSVNMLCTFIIAQAFLPMLCRFKFILFFFFGAWVVVMTIFVALFLPETKNVPIEEMVLVWKNHWYWGRFIRDEDVHVGADLEMRGGANGNGKLAGMQ

SEQ ID NO: 4531 - protein, 526 aa, Panicum virgatum
MAGGVVVNTGGGKDYPGKLTMFVLFACIVAATGGLIFGYDIGISGGVTSMNPFLMKFFPSVYRKEQEAERNQSNQYCKFDSQLLTMFTSSLYLAALVASFFAATVTRVAGRKWSMFGGGVTFLFGAALNGAAKNVVMLILGRVLLGIGVGFANQSVPVYLSEMAPARLRGMLNIGFQLMITIGILCANLINYGTAKIKGGWGWRVSLALAAVPAAIIAVGALFLPDTPNSLIDRGHTGAAKRMLKRVRGTEDVEEEYNDLVAASEESKLVAHPWRNILQPRYRPQLVMAIAIPMFQQLTGINVIMFYAPVLFKTLGFADDASLMSAVITGLVNVFATFVSIVTVDRLGRRKLFLQGGTQMLACQIVVGSLIGAKFGFSGVAEIPKAYAAIVVLFICAYVAGFAWSWGPLGWLVPSEIFPLEIRSAGQSINVSVNMLCTFIIAQAFLPMLCRFKFILFFFFGAWVVVMTIFVALFLPETKNVPIEEMVLVWKSHWYWGRFIRDEDVHVGADLEMHGANGNGKLGGAQ

SEQ ID NO: 4532 - protein, 524 aa, Zea mays
MAGGVVVSSGGGKDYPGKLTMFVLFACIVAATGGLIFGYDIGISGGVTSMNPFLMKFFPSVYRKEQEAERNQSNQYCKFDSQLLTMFTSSLYLAALVASFFAATVTRVAGRKWSMFGGGVTFLVGAALNGAAKDVGMLILGRVLLGVGVGFANQSVPVYLSEMAPARLRGMLNIGFQLMVTIGILCANLINYGTAKIRGGWGWRVSLALAAVPAAIIAVGALFLPDTPNSLIDRGYTDAAKRMLKRVRGTDDVEEEYSDLVAASDESKLVAHPWRNILLPRYRPQLVMAIAIPMFQQLTGINVIMFYAPVLFKTLGFADDASLMSAVITGLVNVFATFVSIVTVDRLGRRKLFLQGGTQMLACQIVVGSLIGAKFGFSGVAEIPKAYAAIVVLFICAYVAGFAWSWGPLGWLVPSEIFPLEIRSAGQSINVSVNMLCTFIIAQAFLPMLCRFKFILFFFFGAWVVVMTIFVALFLPETKNVPIEEMVLVWKAHWYWGRFIRDEDVHVGADLEMPSANAKLGGMQ

SEQ ID NO: 4533 - protein, 530 aa, Oryza sativa
MAGGVVVNNGGGKDYPGKLTMFVLFACIVAATGGLIFGYDIGISGGVTSMNPFLIKFFPSVYRKEQAAEKNQSNQYCKFDSPLLTMFTSSLYLAALVASFFASTVTRVAGRKWSMFGGGVTFLVGAALNGAAKNVLMLILGRVLLGVGVGFANQSVPLYLSEMAPARLRGMLNIGFQLMITIGILCANLINYGTAKIKGGWGWRVSLALAAVPAAIIAVGALFLPDTPNSLIDRGHTDAAKRMLRRVRGTDDIEEEYNDLVAASEESKLVAHPWRNILQRRYRPQLTMAIAIPLFQQLTGINVIMFYAPVLFKTLGFADDASLMSAVITGLVNVFATFVSIVTVDRLGRRKLFLQGGTQMLACQIVVGSLIGAKFGFSGVADIPKAYAAFVVLFICAYVAGFAWSWGPLGWLVPSEIFPLEIRSAGQSINVSVNMLFTFIIAQAFLPMLCRFKFILFFFFGAWVVIMTLFVAFFLPETKNVPIEEMVLVWKSHWYWGRFIRDEDVHVGADVEMPAAGNRNGKVDPAKLAN

SEQ ID NO: 4534 - protein, 526 aa, Triticum aestivum
MAGGAVVNTGGGKDYPGKLTMFVLFACIVAATGGLIFGYDIGISGGVTSMNPFLMKFFPGVYHKEQEAEWNQSNQYCKFDSQLLTMFTSSLYLAALVASFFAATVTRVAGRKWSMFAGGVTFLVGAALNGAAKNVLMLILGRVLLGIGVGFANQSVPVYLSEMAPARLRGMLNIGFQLMVTIGILCANLINYGTAKIKGGWGWRVSLALAAVPAGIIAIGALFLPDTPNSLIDRGYTEDAKKMLRRVRGTDDVEEEYSDLVAASEESKLVSHPWRNILQRRYRPQLTFAIAIPFFQQLTGINVIMFYAPVLFKTLGFADDASLMSAVITGLVNVFATFVSIVTVDRLGRRKLFLQGGTQMLACQIVVGSLIGAKFGFTGVADIPKGYAAFVVFFICAYVAGFAWSWGPLGWLVPSEIFPLEIRSAGQSITVSMNMLCTFIIAQAFLPMLCRFKFMLFFFFGAWVVVMTLFVAFFLPETKNVPIEEMVLVWKAHWYWGRFIRDEDVHVGGADVEMRSNGKVQAAKLP

SEQ ID NO: 4535 - protein, 527 aa, Hordeum vulgare
MAGGAVVNTGGGKDYPGKLTMFVLFACIVAATGGLIFGYDIGISGGVTSMNPFLMKFFPGVYHKEQEAERNQSNQYCKFDSQLLTMFTSSLYLAALVASFFAATVSRVAGRKWSMFAGGVTFLVGAALNGAAKNVLMLILGRVLLGIGVGFANQSVPVYLSEMAPARLRGMLNIGFQLMVTIGILCANLINYGTSKIKGGWGWRVSLALAAVPAGIIAIGALFLPDTPNSLIDRGYTDDAKKMLRRVRGTDDVEEEYSDLVAASDESKLVSHPWRNILQRRYRPQLTFAIAIPFFQQLTGINVIMFYAPVLFKTLGFADDASLMSAVITGLVNVFATFVSIVTVDRLGRRKLFLQGGTQMLACQIVVGSLIGAKFGFTGVADIPRGYAAFVVFFICAYVAGFAWSWGPLGWLVPSEIFPLEIRSAGQSITVSMNMLCTFIIAQAFLPMLCRFKFMLFFFFGAWVIVMTLFVAFFLPETKNVPIEEMVLVWKAHWYWGRFIRDEDVHVGADVEMRSNGNGKIQAAKLP

SEQ ID NO: 4536 - protein, 538 aa, Secale cereale
MAGGAVVNTGGGKDYPGKLTMFVLFACIVAATGGLIFGYDIGISGGVTSMNPFLMKFFPGGVPPGAGGGAEPEQPVLQVRQPAAHHVHLLALPRRARRFLLRRHRHPRRRPQVVHVRRRGHLPRRRRAQRRRQERPHAHPRARPARHRGRLRQPVGAGLPVGDGAGEAEGDAQHRVPADGHDRHPVREPDQLRDGQDQGRVGLAREPRAGRGAGRNHRHRRALPPRHPQLPHRPRLHRRRQEDAPARARHGRRRGGVQRPGGRQRGVQAREPSVAQHPPAPVPAAAHLRDRHPLLPAAHRHQRHHVLRARALQDARVRGRRVPHVRRHHRPRQRLRHLRVHRDRGPAGPAQALPAGRHPDAGLPDRGGQPDRRQVRVHRRGRHPQGVRGVRGALHLRVRGRVRVVLGPAGVARPQRDLPAGDQVGGAEHHRVHEHAVHLHHRAGVSPHALPLEVHALLLLRRVGDRHDPLRCLLPAGDQERAHRGDGARVEGALVLEPLHPRRGRARRRRRRRRDELQRQGPGCQAPVTPKRVAGARQ

SEQ ID NO: 4537 - protein, 530 aa, Brachypodium distachyon
MAGGAVVNTGGGKDYPGKLTMFVLFACIVAATGGLIFGYDIGISGGVTSMNPFLMKFFPAVYRQEQEAERNQSNQYCKFDSQLLTMFTSSLYLAALVASFFAATVTRVAGRKWSMFAGGVTFLAGAALNGAAKDVLMLILGRVLLGIGVGFANQSVPVYLSEMAPARLRGMLNIGFQQMITIGILCANLINYGTAKIKGGWGWRVSLALAAVPAAIIAVGALFLPDTPNSLIDRGYTDDAKRMLRRVRGTDDVDEEYRDLVAASEESKLVSHPWRNILQRRYRPQLTFAIAIPFFQQLTGINVIMFYAPVLFKTLGFADDASLMSAVITGLVNVFATSVSIVTVDRLGRRKLFLQGGVQMLVCQIVVGGLIGAKFGFSGVAVIPKEYAAFVVLFICAYVAGFAWSWGPLGWLVPSEIFPLEIRSAGQSITVSVNMFCTFVIAQAFLPMLCRFKFMLFFFFGAWVVLMTLFVAFFLPETKNVPIEEMVLVWKAHWYWGRFIRDEDVHVGADVEMPASGKNKIQPGNGKLGI

SEQ ID NO: 4538 - protein, 526 aa, Avena sativa
MAGGAVVNTGGGKDYPGKLTMFVLFACIVAATGGLIFGYDIGISGGVTSMNPFLIKFFPGVYRQEQEAERNQSNQYCKFDSQLLTMFTSSLYLAALVASFFAATVTRVAGRKWSMFAGGVTFLAGAALNGAAKNVLMLILGRVLLGIGVGFANQSVPVYLSEMAPARLRGMLNIGFQMMITIGILCANLINYGTAKIKGGWGWRVSLALAAVPAAIIAIGSLFLPDTPNSLIDRGYTVEAKRMLRRVRGTDDVQEEYNDLVAASDESKLVSHPWRNILQRRYRPQLTFAIAIPFFQQLTGINVIMFYAPVLFKTLGFADDASLMSAVITGLVNVFATFVSILTVDRLGRRKLFLQGGTQMLACQIVIGSLIGAKFGFTGVADIPKGYAAFVVLFICAYVAGFAWSWGPLGWLVPSEIFPLEIRSAGQSITVSVNMLCTFIIAQAFLPMLCRFKFMLFFFFGAWVVVMTLFVAFFLPETKNVPIDEMVLVWKSHWYWSRFIRDEDVHVGADVEMRSNGKIQAAKLNI

SEQ ID NO: 4539 - protein, 461 aa, Pennisetum glaucum
MAGGVVVNTGGGKDYPGKLTMFVLFACIVAATGGLIFGYDIGISGGVTSMNPFLKKFFPSVYRKEQEAERNQSNQYCKFDSQLLTMFTSSLYLAALVASFFAATVTRVAGRKWSMFGGGVTFLVGAALNGAAKDVVMLILGRVLLGIGVGFANQSVPVYLSEMAPARLRGMLNIGFQLMITIGILCANLINYGTAKIKGGWGWRVSLALAAVPAAIIAIGALFLPDTPNSLIDRGYTDSAKRMLKRVRGTEDVEEEYNDLVAASEESKLVAHPWRNILQRRYRPQLVMAIAIPMFQQLTGINVIMFYAPVLFKTLGFADDASLMSAVITGLVNVFATFVSIVTVDRLGRRKLFLQGGAQMLACQIVVGSLIGAKFGFTGVAEIPKAYAAIVVLFICAYVAGFAWSWGPLGWLVPSEIFPLEIRSAGQSINVSVNMLCTFIIAQAFLPMLCRDDEGAEHQRV

SEQ ID NO: 4540 - protein, 174 aa, Saccharum officinarum
MRYRRAYAQPWGRSRLRYVNDGRPFWQYIVSSSTGCSDLQYFEELYQYYTTEKAWHLCDPDAGRVFEALRRAGVKTAVVSNFDTRLRPLLQALKCDCWFDAVAISAEVAAEKPNPTIFLKACELLGVKPEEAVHIGDDRRNDIWGARDAGCDAWLWGSDVYSFKEVAERIGVEV

SEQ ID NO: 4541 - protein, 280 aa, Zea mays
MAVARLRAVAAAVLQPALAAGGRGERRPLGTAAEVAAGAGPGAARWELLGAREYYDYRRAMYGDITHKAILVDAAGTLLAPTEPMAQVYRTIGQKYGVNYSEDEILMRYRLAYAQPWGRSRLRYVDDGRPFWQHIVSSSTGCSDLQYFEELYQYYTTEKAWRLCDPDAGRVFEALRRAGVKTAIVSNFDTRLRPLLQALKCDGWFDAVAVSAEVAAEKPNPTIFLKACELLGVKPEEAVHIGDDRRNDLWGARDAGCDAWLWGSDVYSFKEIAERIGVEV

SEQ ID NO: 4542 - protein, 272 aa, Zea mays
MAVARLCAAAAAARLQPALAAGARGLGTAAEVAAGARWEPMGAREYYDYRRAMYGDITHKAILVDAAGTLLAPTEPMAQVYRTIGQKYGVDYSEDEILMRYRWAYAQPWGRSRLRYVNDGRPFWQYIVSSSTGCSNLEYFEELYQYYTTEKAWHLCDPDAGRVFEALRKAGVKTAVVSNFDTRLRPLLQALKCDRWFDAVAVSAEVAAEKPNPTIFLKACELLGVKPEEVVHIGDDRRNDLWGARDAGCDAWLWGSDVYSFKEVAERIGVEV

SEQ ID NO: 4543 - protein, 290 aa, Setaria italica
MAAALLRSAADRLRPALAAGARGERRLLATAAAEVTVDAGAAAAAAVAAAVARWEIMGAGAREYYDYRRAIYGDITHKAILVDAAGTLLAPTEPMAQVYRTIGQKYGVDYSEDEILMRYRRAYAQPWGKSRLRYVNDGRPFWQYIVSSSTGCSDLQYFEELYQYYTTEKAWHLCDPDAGRVFQALRRAGVKTAVVSNFDTRLRPLLQALKCDHWFDAVAISAEVAAEKPNPTIFLKACELLGVKPEEAVHIGDDRRNDLWGARDAGCDAWLWGSDVYSFKEVAERIGVEV

SEQ ID NO: 4544 - protein, 282 aa, Oryza sativa
MAVAARLRSAGARLVVGPAAMAVGRGGGGEGRWMGTATAEAAAGIARWEPMGAREYYDYRRAIYGDITHKAILVDAAGTLLAPTEPMAQVYRTIGEKYGVNYSEDEILMRYRRAYAQPWGRSRLRYVDDGRPFWQHIVSSSTGCSDLQYFEELYQYYTTAKAWQLCDPDAKYVFEALRKAGVKTAVVSNFDTRLRPLLQALNCDHWFDAVAVSAEVAAEKPNPTIFLKACEFLGVKPEEAVHIGDDRRNDLWGARDAGCDAWLWGSDVYSFKEVAERIGVKV

SEQ ID NO: 4545 - protein, 284 aa, Triticum aestivum
MAVARLRSAAAARLQPALAGRRRLGTAAAAEAPEAVVGAGSARWEPMGAREYYDYRRAIYGDITHKAILVDAAGTLLAPTEPMAQVYRTVGEKYGVKYSEDEILMRYRQAYAQPWGRSRLRYVDDGRPFWQHIVSSSTGCSDLEYFEELYHYYTTEKAWQLIDPDAKYVFEALRRAGVRTAVVSNFDTRLRPLLQALNCDHWFDAVAVSAEVAAEKPNPTIFLKACELLDVKPEEAVHIGDDRRNDLWGARDAGCDAWLWGSDVHSFKEVAERIGVSVGMGNNM

SEQ ID NO: 4546 - protein, 287 aa, Triticum aestivum
MAVARLRSATAAAAARLQPALAGRRRLGTAAAAEAPEAVVGAGSARWEPMGAREYYDYRRAIYGDITHKAILVDAAGTLLAPTEPMAQVYRTVGEKYGVKYSEDEILMRYRQAYAQPWGRSRLRYVDDGRPFWQHIVSSSTGCSDLQYFEELYHYYTTEKAWRLIDPDAKYVFEALRRAGVRTAVVSNFDTRLRPLLQALNCDHWFDAVAVSAEVAAEKPNPTIFLKACELLDVKPEEAVHIGDDRRNDLWGARDAGCDAWLWGSDVHSFKEVAERIGVSVGMGNNM

SEQ ID NO: 4547 - protein, 284 aa, Triticum aestivum
MAVARLRSATAARLQPALAGRRRLGTAAAAEAPEAVVGAGGARWEPMGAREYYDYRRAIYGDITHKAILVDAAGTLLAPTEPMAQVYRTVGEKYGVKYSEDEILMRYRQAYSQPWGRSRLRYVDDGRPFWQHIVSSSTGCSDLQYFEELYHYYTTEKAWRLIDPDAKYVFEALRRAGVRTAVVSNFDTRLRPLLQALNCDHWFDAVAVSAEVAAEKPNPTIFLKACELLDVKPEEAVHIGDDRRNDLWGARDAGCDAWLWGSDVHSFKEVAERIGVSVGMGNNM

SEQ ID NO: 4548 - protein, 292 aa, Avena sativa
MAVARLRSASSAAAARLQPALAGRGEDRRRHLGTAAAAAAVADAVGAGAARWEPMGAREYYDYRRAIYGDITHKAILVDAAGTLLAPTEPMAQVYRTLGEKYGVKYSEDEILMRYRQAYAQPWGRSRLRYVDDGRPFWQHIVSSSTGCSDLEYFEELYHYYTTEKAWQLIDPDAKYVFEALRRAGVRTAVVSNFDTRLRPLLQALNCDHWFDAVAVSAEVAAEKPNPTIFLKACELLGVKPEEAVHIGDDRRNDLWGARDAGCDAWLWGSDVHSFKEVAERIGVSVGMGNCM

SEQ ID NO: 4549 - protein, 292 aa, Avena sativa
MAVARLRSASSAAAARLQPALAGRGEDRRRHLGTAAAAAVVADAVGAGAARWEPMGAREYYDYRRAIYGDITHKAILVDAAGTLLAPTEPMAQVYRTLGEKYGVKYSEDEILMRYRQAYAQPWGRSRLRYVDDGRPFWQHIVSSSTGCSDLEYFEELYHYYTTEKAWQLIDPDAKYVFEALRRAGVRTAVVSNFDTRLRPLLQALNCDHWFDAVAVSAEVAAEKPNPTIFLKACELLGVKPEEAVHIGDDRRNDLWGARDAGCDAWLWGSDVHSFKEVAERIGVSVGMGNCM

SEQ ID NO: 4550 - protein, 294 aa, Avena sativa
MAVARLRSASSAAAARLQPALAGRAEDRRRHLGTAAAAAVVADAVGAGAGAARWEPMGAREYYDYRRAIYGDITHKAILVDAAGTLLAPTEPMAQVYRTLGEKYGVKYSEDEILMRYRQAYAQPWGRSRLRYVDDGRPFWQHIVSSSTGCSDLEYFEELYHYYTTEKAWQLIDPDAKYVFEALRRAGVRTAVVSNFDTRLRPLLQALNCDHWFDAVAVSAEVAAEKPNPTIFLKACELLDVKPEEAVHIGDDRRNDLWGARDAGCDAWLWGSDVHSFKEVAERIGVSVGMGNCM

SEQ ID NO: 4551 - protein, 285 aa, Brachypodium distachyon
MAAARLRSATAVAAAARVVGCGEGTRRMLGTAAAAEVAEAGGARWEPMGAREYYDYRRAIYGDITHKAILVDAAGTLLAPTEPMAQVYRTLGEKYGVKYSEEEILMRYRQAYAQPWGRSRLRYVDDGRPFWQHIVSSSTGCSDLQYFEELYCYYTTEKAWQLIDPDAKYVFEALRRAGVRTAVVSNFDTRLRPLLQALKCDHWFDAVAVSAEVAAEKPNPTIFLKACELLGVKPEEAVHIGDDRRNDLWGARDAGCDAWLWGSDVHSFKEVAERIGVKVGMGNSM

SEQ ID NO: 4552 - protein, 290 aa, Triticum aestivum
MAVARLRSATATAAAAGARLQPALAGRRHLGTAAAAEAPEAVVGAGGARWEPMGAREYYDYRRAIYGDITHKAILVDAAGTLLAPTEPMAQVYRTVGEKYGVKYSEDEILMRYRQAYSQPWGRSRLRYVDDGRPFWQHIVSSSTGCSDLQYFEELYHYYTTEKAWRLIDPDAKYVFEALRRAGVRTAVVSNFDTRLRPLLQALNCDHWFDAVAVSAEVAAEKPNPTIFLKACELLDVKPEEAVHIGDDRRNDLWGARDAGCDAWLWGSDVHSFKEVAERIGVSVGMGNNM

SEQ ID NO: 4553 - protein, 258 aa, Setaria italica
AEVTVDAGAAAAAAVAAAVARWEIMGAGAREYYDYRRAIYGDITHKAILVDAAGTLLAPTEPMAQVYRTIGQKYGVDYSEDEILMRYRRAYAQPWGKSRLRYVNDGRPFWQYIVSSSTGCSDLQYFEELYQYYTTEKAWHLCDPDAGRVFQALRRAGVKTAVVSNFDTRLRPLLQALKCDHWFDAVAISAEVAAEKPNPTIFLKACELLGVKPEEAVHIGDDRRNDLWGARDAGCDAWLWGSDVYSFKEVAERIGVEV

SEQ ID NO: 4554 - protein, 295 aa, Festuca arundinacea
  misc_feature (44)..(44): Xaa can be any naturally occurring amino acid
  misc_feature (206)..(206): Xaa can be any naturally occurring amino acid
MAVARLRSASSAAARLQPALAGRGEERRRYLGTAAAAAAAEAEXAVAVGAVGARWEPMGAREYYDYRRAIYGDITHKAILVDAAGTLLAPTEPMAQVYRTLGEKYGVKYSEDEILMRYRQAYAQPWGRSRLRYVDDGRPFWQHIVSSSTGCSDLEYFEELYHYYTTEKAWQLIDPDAKYVFEALRRAGVRTAVVSNFDTRLRPLLXALNCDHWFDAVAVSAEVAAEKPNPTIFLKACELLDVKPEEAVHIGDDRRNDLWGARDAGCDAWLWGSDVHSFKEVAERIGVSVGMGNSM

SEQ ID NO: 4555 - protein, 250 aa, Pennisetum glaucum
GVTAVAAAAAVARWELMGAGAREYYDYRRAIYGDITHKAILVDAAGTLLAPTEPMAQVYRTIGQKYGVEYSEGEILTRYRRAYAQPWGASRLRYVDDGRPFWQYIVSSSTGCSDLQYFEELYQYYTTEKAWRLCDPDAGRVFQALRRAGVKTAVVSNFDTRLRPLLQALKCDHWFDAVAISAEVAAEKPNPTIFLKACELLGVKPEEAVHIGDDRRNDLWGARDAGCDAWLWGSDVYSFKEVAERIGVEV

SEQ ID NO: 4556 - protein, 260 aa, Triticum aestivum
GTAAAAEAPEAVVGAGSARWEPMGAREYYDYRRAIYGDITHKAILVDAAGTLLAPTEPMAQVYRTVGEKYGVKYSEDEILMRYRQAYAQPWGRSRLRYVDDGRPFWQHIVSSSTGCSDLQYFEELYHYYTTEKAWRLIDPDAKYVFEALRRAGVRTAVVSNFDTRLRPLLQALNCDHWFDAVAVSAEVAAEKPNPTIFLKACELLDVKPEEAVHIGDDRRNDLWGARDAGCDAWLWGSDVHSFKEVAERIGVSVGMGNNM

SEQ ID NO: 4557 - protein, 232 aa, Panicum virgatum
MGAREYYDYRRAIYGDITHKAILVDAAGTLLAPTEPMAQVYRTIGQKYGVEYSEDEILMRYRRAYAQPWGRSRLRYVNDGRPFWQHIVSSSTGCSDLQYFEEVYQYYTTEKAWHLCDPDAGRVFQALRRAGVKTAVVSNFDTRLRPLLQALKCDQWFDAVAVSAEVAAEKPNPTIFLKACELLGVKPEETVHIGDDRRNDVWGARDAGCDAWLWGSDVYSFKEVAERIGVEV

SEQ ID NO: 4558 - protein, 391 aa, Zea mays
MASPAAVKKVLVPIAAGSEPAEAFVPIAVLRRAGADVTVAAAGAGTGLRVHAMYGVTVVADASVADCADASYDLVVLPGGVPGADNLGGCAALEGIVRRHALGGGLCAAICAAPPLALARWGLLDGVKATAHPEFVDKFPAEVAGVDANVVVDGRVVTGRGPAAAMEFALALVDQLYGKGKVDEIAKPMMVRYEPGYAFEELNPVQWRCSGTPRVLIPVANGSEEMEVLVTVDVLRRAKADVVVASAEEVVVARHGTRIVADALLQDAAGQQFDLIVVPGGMPGVKTTLADKVELMALLKEHAAAGRAYGAIGAATAQVLEPHGLIGGSMKATTCASRADRPSECGSRVVVDGNLATSGSTGTAMEFALAVVEKLLGPEAAREVAEALLFV

SEQ ID NO: 4559 - protein, 120 aa, Zea mays
MQAVGIRRGLTIDPAGEEEAPAARVWRLVRESPVVIFARRGCCMAHVMRRLLAAVGAHATVIELDAGAAEEQELAAAVEGGGVPALFVGGDPVGGLEGLMGLHLSGRLVPRLRELGALCA

SEQ ID NO: 4560 - protein, 120 aa, Zea mays
MQAVGIRRRGLTIDPAGEEEAPAARVGRLVRESPVVIFARRGCCMAHVMRRLLAAVGAHATVIELGSAEEEEEELAAAEGGGVPALFVGGDPVGGLEGLMRLHLSGRLVPRLRELGALCA

SEQ ID NO: 4561 - protein, 121 aa, Pennisetum glaucum
MQAVGIRRGLTIDPAGEEEPPAVRVGRLVRESPVVIFARRGCYMAHVMKSLLAAVGAHATVIELDAGAADELAAAAEAGRGAVPALFVGGAPVGGLEGLMDLHLSGRLVPRLREVGALLCA

SEQ ID NO: 4562 - protein, 121 aa, Setaria italica
MQAVGIRRGLTIDPAGEEEAPAARVGRLVRESPVVIFARRGCYMAHVMKRLLAAVGAHATVIELDAGAADELAAAAAEAGRGAVPALFVGGAPVGGLEGLMDLHLSGRLVPRLREVGALCA

SEQ ID NO: 4563 - protein, 114 aa, Saccharum officinarum
MQAVGIRRGLTIDPAGEEEPAAARVGRLVRESPVVIFARPGCCMAHVMKRLLQAVGAHATVIELDAGAAEEEELAADEAGGDPTRFVGGDPVGGLQGLMGPHLNGRLLPRLKEL

SEQ ID NO: 4564 - protein, 437 aa, Zea mays
MAIGGKEVKDDLEEAPPPVLDEAMRPRRVALFVEPSPFAYISGYKNRFQNFIKHLREMGDEVIVVTNHEGVPQEFHGAKVIGSWSFPCPMYGKVPLSLALSPRIISEVAKFKPDIIHASSPGIMVFGALAIAKLLGVPLVMSYHTHVPVYIPRYTFSWLVEPMWQVIRFLHRAADLTLVPSAAISKDFETAQVISANRIRLWNKGVDSASFHPRFRSHEMRVRLSDGEPEKPLVIHVGRFGREKSLDFLKMVMERLPGVRIAFIGDGPYRGELEKMFEGMPAVFTGMMQGEELSQAYASGDVFIMPSESETLGQVVLESMSSGVPVVAARAGGIPDIIPEDQEGRTSFLFTPGDLDDCLGKVQQLLTNREFRENMGRTARSEMEKCDWRAASKTIRNEFYNAAIWYWRKKHAELVKPLQWLAQMFLPAPEVRSIMQC

SEQ ID NO: 4565 - protein, 437 aa, Setaria italica
MAIGGKEIKEDLEEAPPLLLDEAARPRRVALFVEPSPFAYISGYKNRFQNFIKHLREMGDEVIVVTNHEGVPEEFHGAKVIGSWSFPCPMYGKVPLSLALSPRIISEVAKFKPDIIHASSPGIMVFGALAIAKLLSVPLVMSYHTHVPVYIPRYTFSWLVEPMWQVIRFLHRAADLTLVPSAAISKDFETAHVISANRIRLWNKGVDSASFHPRFRSHEMRVRLSDGEPEKPLIIHVGRFGREKNLDFLKIVMDRLPGVRIAFIGDGPYRTELEKMFEGMPAVFTGMMQGEELSQAYASGDVFVMPSESETLGQVVLESMSSGVPVVAARAGGIPDIIPEDQEGKTSFLFTPGDLDDCVGKVQLLLTNREFRDNMGRTARAEMEKCDWRAASKTIRNEFYNAAIWYWRKKRAELVQPLQWLAQMFLPAPEVRSITKC

SEQ ID NO: 4566 - protein, 533 aa, Oryza sativa
MPCKVPSLVPFPPIFSTPPMEYPPQFPTPQLHTPISSSSSSSSSPRLYTRRVELLLLLFLAPPQHRRLEAHANAGSEEKDCFFFFFCVCAVFLGFLAMVIGAEIKDEMEEAPPLLLDEAARPRRVALFVEPSPFAYISGYKNRFQNFIKHLREMGDEVIVVTNHEGVPQEFHGAKVIGSWSFPCPMYGKVPLSLALSPRIISEVAKFKPDIIHASSPGIMVFGALAIAKLLGVPLVMSYHTHVPVYIPRYTFSWLVEPMWQVIRFLHRAADLTLVPSVAISKDFETAHVISANRIRLWNKGVDSASFHPKFRSHEMRVRLSDGEPEKPLIIHVGRFGREKNLDFLKTVMDRLPGVRIAFIGDGPYRSELEKMFEGMPAVFTGMMQGEELSQAYASGDVFVMPSESETLGQVVLESMSSGVPVVAARAGGVPDIIPEDQEGKTSFLFTPGDLEDCLGKIQLLLTDKEFRDNMGMTARAEMEKCDWRAASKKIRNEFYNAAIWYWRKKRAELIKPLQWLAQMFLPAPEVNRITQH

SEQ ID NO: 4567 - protein, 436 aa, Oryza sativa
MVIGAEIKDEMEEAPPLLLDEAARPRRVALFVEPSPFAYISGYKNRFQNFIKHLREMGDEVIVVTNHEGVPQEFHGAKVIGSWSFPCPMYGKVPLSLALSPRIISEVAKFKPDIIHASSPGIMVFGALAIAKLLGVPLVMSYHTHVPVYIPRYTFSWLVEPMWQVIRFLHRAADLTLVPSVAISKDFETAHVISANRIRLWNKGVDSASFHPKFRSHEMRVRLSDGEPEKPLIIHVGRFGREKNLDFLKTVMDRLPGVRIAFIGDGPYRSELEKMFEGMPAVFTGMMQGEELSQAYASGDVFVMPSESETLGQVVLESMSSGVPVVAARAGGVPDIIPEDQEGKTSFLFTPGDLEDCLGKIQLLLTDKEFRDNMGMTARAEMEKCDWRAASKKIRNEFYNAAIWYWRKKRAELIKPLQWLAQMFLPAPEVNRITQH

SEQ ID NO: 4568 - protein, 437 aa, Panicum virgatum
MAVGGKEIKEDLEEAPPLLLDEAARPRRVALFVEPSPFAYISGYKNRFQNFIKHLREMGDEVIVVTNHEGVPEEFHGAKVIGSWSFPCPMYGKVPLSLALSPRIISEVAKFKPDIIHASSPGIMVFGALAIAKLLSVPLVMSYHTHVPVYIPRYTFSWLVEPMWQVIRFLHRAADLTLVPSAAISKDFETAQVISANRIRLWNKGVDSASFHPRFRSHEMRIRLSDGEPDKPLIIHVGRFGREKNLDFVKMVMDRLPGIRIAFIGDGPYRTELENMFEGMPAVFTGMMQGDELSQAYASGDVFIMPSESETLGQVVLESMSSGVPVVAACAGGIPDIIPEDQDGKTSFLFTPGDLDDCVGKVQLLLTNREFRDNMARTARSEMEKCDWRAASKTIRNEFYDAAIWYWRKKRADMVQPLQWLAQMFLPGLEVRRITQC

SEQ ID NO: 4569 - protein, 439 aa, Triticum aestivum
MAIGADGLEEAPPLLLDGEEAAYSRPRRVALFIEPSPFAYISGYKNRFQNFIKHLREMGDEVIVVTNHEGVPQEFHGAKVIGSWSFPCPLYGKVPLSLALSPRIISEVAKFKPDIIHASSPGIMVFGALAIAKLLSVPLVMSYHTHVPVYIPRYTFSWLVEPMWQIIRFLHRAADLTLVPSAAISKDFETAHVISANRIRLWNKGVDSASFHPRFRSHEMRVRLSDGEPEKPLIIHVGRFGREKNLDFLKMVMDRLPGVRIAFIGDGPYRTELEKMFEGMPAVFTGMMQGEELSQAYASGDVFVMPSESETLGQVVLESMSSGVPVVAVRAGGIPDIIPEDVEGRTSFLFAPGDLDDCVGKIRLLLTDDEFRGEMGRTARAEMEKCDWRAASKTIRNEFYSSAIDYWRKKQAEMVQPLQWLAQMFMPAPNRVIGGGIKQ

SEQ ID NO: 4570 - protein, 439 aa, Brachypodium distachyon
MAIGGEIKDDLEEAPPPPLLDEASLRPRRVALFVEPSPFAYISGYKNRFQNFIKHLREMGDEVIVVTNHEGVPQEFHGAKVIGSWSFPCPLYGKVPLSLALSPRIISEVAKFKPDIIHASSPGIMVFGALAIAKLLSVPLVMSYHTHVPVYIPRYTFSWLVEPMWQIIRFLHRAADLTLVPSAAISKDFETAHVISANRIRLWNKGVDSASFHPRFRSHEMRVRLSDGEPEKPLIIHVGRFGREKSLDFLKTVMDQLPGVRIAFVGDGPYRTELEKMFEGMPAVFTGMMQGEELSQAYASGDIFVMPSESETLGQVVLESMSSGVPVVAARAGGIPDIIPEEEEGKTSFLFTPGNLDDCVGKIKLLLTDREFRDSMGRTARAEMEKCDWRTASRTIRNEFYNTAIFYWRKKRAELVQPLQWLAQMFLPATDRTRSITQH

SEQ ID NO: 4571 - protein, 440 aa, Triticum aestivum
MAIGTDDLEEAPPLLLLDDDEAAYPRPRRVALFVEPSPFAYISGYKNRFQNFIKHLREMGDEVIVVTNHEGVPQEFHGAKVIGSWSFPCPLYGKVPLSLALSPRIISEVAKFKPDIIHASSPGIMVFGALAIAKLLSVPLVMSYHTHVPVYIPRYTFSWLVEPMWQVIRFLHRAADLTLVPSVAIIKDFETAHVISANRIRLWNKGVDSASFHPRFRSHEMRVRLSDSEPDKPLIIHVGRFGREKNLDFLKMVMDRLPGVRIAFVGDGPYRTELEKMFEGMPAVFTGMMQGEELSQVYASGDVFVMPSESETLGQVVLESMSSGVPVVAVRAGGIPDIIPGDAEGRTSFLFAPGDLDDCVGKIRLLLTDDEFRGDMGRTARAEMEKCDWRAASKTIRNEFYSSAIDYWRKKQADIVQPLQWLAQMFMPAPNRVIGGGIKQ

SEQ ID NO: 4572 - protein, 437 aa, Hordeum vulgare
MAIGVDDLEAAPPPLLDDEAAYPRPRRVALFVEPSPFAYISGYKNRFQNFIKHLREMGDEVIVVTNHEGVPQEFHGAKVIGSWSFPCPLYGKVPLSLALSPRIISEVARFKPDIIHASSPGIMVFGALAIAKLLSVPLVMSYHTHVPLYIPRYTFSWLVEPMWQVIRFLHRAADLTLVPSAAISKDFETAHVISANRIRLWNKGVDSASFNPRFRSHEMRVRLSDGEPEKPLIIHVGRFGREKNLDFLKMVMDRLPGVRIAFIGDGPYRTELEKMFEGMPAVFTGMMQGEELSQAYASGDVFVMPSESETLGQVVLESMSSGVPVVAVRAGGIPDIIPEDVEGRTSFLFAPGDLDDCVGKIRLLLTDDEFRGDMGRAARAEMEKCDWRAASKMIRNEFYSSAIDYWRKQQAEIVQPLQWLAQMFMPAPNQVIGGIKQ

SEQ ID NO: 4573 - protein, 66 aa, Setaria italica
MAIGGKEIKEDLEEAPPLLLDEAARPRRVALFVEPSPFASVKDSRLVCVAYFGFLVGCVGHCCDQS

SEQ ID NO: 4574 - protein, 440 aa, Triticum aestivum
MAIGTDDLEEAPPLLLLDDDEAAYPRPRRVALFVEPSPFAYISGYKNRFQNFIKHLREMGDEVIVVTNHEGVPQEFHGAKVIGSWSFPCPLYGKVPLSLALSPRIISEVAKFKPDIIHASSPGIMVFGALAIAKLLSVPLVMSYHTHVPVYIPRYTFSWLVEPMWQVIRFLHRAADLTLVPSVAIIKDFETAHVISANRIRLWNKGVDSASFHPRFRSHEMRVRLSDSEPDKPLIIHVGRFGREKNLDFLKMVMDRLPGVRIAFVGDGPYRTELEKMFEGMPAVFTGMMQGEELSQVYASGDVFVMPSESETLGQVVLESMSSGVPVVAVRAGGIPDIIPGDAEGRTSFLFAPGDLDDCVGKIRLLLTDDEFRGDMGRTARAEMEKRDWRAASKTIRNEFYSSAIDYWRKKQADIVQPLQWLAQMFMPAPNRVIGGGIKQ

SEQ ID NO: 4575 - protein, 220 aa, Hordeum vulgare
MAIGVDDLEAAPPPLLDDEAAYPRPRRVALFVEPSPFAYISGYKNRFQNFIKHLREMGDEVIVVTNHEGVPQEFHGAKVIGSWSFPCPLYGKVPLSLALSPRIISEVARFKPDIIHASSPGIMVFGALAIAKLLSVPLVMSYHTHVPLYIPRYTFSWLVKPMWQVIRFLHRAADLTLVPSAAISKDFETAHVISANRIRLWTKASIPPASTPGSAAMRCA

SEQ ID NO: 4576 - protein, 389 aa, Pennisetum glaucum
QNFIKHLREMGDEVIVVTNHEGVPEEFHGAKVIGSWSFPCPMYGKVPLSLALSPRIISEVAKFKPDIIHASSPGIMVFGALAIAKLLSVPLVMSYHTHVPVYIPRYTFSWLVEPMWQVIRFLHRAADLTLVPSAAISKDFETAQVISANRIRLWNKGVDSASFHPRFHSQEMRVRLSNGEPERPLIIHVGRFGREKNLDFLKMVMDRLPGVRIAFIGDGPYRTELEKMFEGMPAVFTGMMQGEELSQAYASGDVFIMPSESETLGQVVLESMSSGVPVVAARAGGIPDIIPEDQEGKTSFLFTPGDLDDCVGKVQLLLTNREFRDSMGRTARAEMEKCDWRAASKTIRNEFYNAAIWYWRKKRAELVQPLQWLAQMFLPAPEVRSITKC

SEQ ID NO: 4577 - protein, 308 aa, Panicum virgatum
MVPLRSCHRFAHLRLFSFLSMAAPQQPGKTPLRPNPSPSPTGSAPKRSRTMATDAAAAGPPASKGCPAMKAEFAKHAEYLNALNDKRERLVKASRDITMNSKKVIFQVHRASKVNKEEVLSKAENDLAAVVNQYIGKLVKELQGTDFWKLRRAYTFGVQEYVEAATLCRFCKTGTLLSLAEINDSLLALSDKSVEPLQINVLDYLLGVADLSGELMRLAIGRISDGEVEYAKKICAFVRDIYRELTLVVPLMDDNSEMKKKMEVMLQSVVKIENACFSVHVRGSEYIPLLGSSADPDYSFFGASDFDQ

SEQ ID NO: 4578 - protein, 305 aa, Setaria italica
MVPLRFAHLRLFSFLSMAAPQQPGKTLLRPNPSPSPAGSVPKRSRTMATDAAAAADPPASKGCPAMKAEFAKHAEYLNALNDKRERLVKASRDITMNSKKVIFQVHRISKVNKEEVLCKAENDLAAVVNQYIGKLVKELQGTDFWKLRRAYTFGVQEYVEAATLCRFCKTGTLLTLAEINDSLLALSDKSVEPLQINVLDYLLGVADLSGELMRLAIGRISDGEVEYAKKICAFVRDIYRELTLVVPLMDDNNEMKKKMEVMLQSVVKIENACFSVHVRGSEYIPLLGSSADPDYSFFGASDFDQ

SEQ ID NO: 4579 - protein, 308 aa, Cenchrus ciliaris
MVPLRGCHRFAHLRLFSLLSMAAPQQPGKPLLRPNPSPSPAGSVPKRSRTMATDAAAADPPASKGCPAMKAEFAKHAEYLNALNDKRERLVKASRDITMNSKKVIFQVHRISKVNKEEVLSKAENDLAAVVNQYIGKLVKELQGTDFWKLRRAYTFGVQEYVEAATLCRFCKTGTLLSLSEINDSLLALSDKSVEPLQINALDYLLGVADLSGELMRLAIGRISDGEVEYAKKICAFVRDIYRELTLVVPLMDDNNEMKKKMEVMLQSVVKIENACFSVHVRGSEYIPLLGSSADPDYSFFGASDFDQ

SEQ ID NO: 4580 - protein, 258 aa, Eragrostis curvula
MATDAAAAATAGSKGCPAMKAEFAKHAEYLNALNDKRERLVKASRDITMNSKKVIFQVHRISKANKEEVLSKAENDLATVVNQYIGKLVKELHGTDFWKLRRAYTFGVQEYVEAATFCRFCKTGTLLSLTEINESLLALSDKSVDPLQINVLDYVLGVADLSGELMRLAIGCISDGEVEYAKNICSFVRDIYRELTLVVPLMDDNMEMKKKMEVMLQSVLKIENACFSVHVRGSEYFPLLRSSADPDYSFFGASDFEP

SEQ ID NO: 4581 - protein, 314 aa, Triticum aestivum
MVPLRVCHRLVHLRGLPSSLRLPLPSTMAAPQPGCKTLRPTTTSSPSPAGPATKRSRTMATDAAASPASAGCSAMKAEFTGHAEYLNALNDKRERLVKASRDVTMNSKKVIFQVHRISKNNKEEVLSKAENDLAAVVNQYIGKLVKELQGTDFWKLRRAYTPGVQEYIEAATFCRFCKTGTLLGLAEINDSLLALSDKSIEPLQINVLDYLLGVADLSGELMRLAIGRISDGEVEYAKNICAFVRDIYRELTLLVPLMDDNNEMKKKMEVMLQSVVKIENACFSVHVRGSEYIPMLGSSGESDYAFFGAADYDQ

SEQ ID NO: 4582 - protein, 314 aa, Triticum aestivum
MVPLRVCHRLVHLRGLPSSLRLPLPSTMAAPQPGCKTLRPTTTSSPSPAGPATKRSRTMATDAATSPASAGCSAMKAEFTGHAEYLNALNDKRERLVKASRDVTMNSKKVIFQVHRISKNNKEEVLSKAENDLAAVVNQYIGKLVKELQGTDFWKLRRAYTPGVQEYIEAATFCRFCKTGTLLGLAEINDSLLALSDKSIEPLQINVLDYLLGVADLSGELMRLAIGRISDGEVEYAKNICAFVRDIYRELTLLVPLMDDNNEMKKKMEVMLQSVVKIENACFSVHVRGSEYIPMLGTSGESDYAFFGAADYDQ

SEQ ID NO: 4583 - protein, 306 aa, Secale cereale
RLVRLRGLPSSLRLPLPSTMAAPQPGCKTLRPSTTSSPSPAGPATKRSRTMATDAAASPASAGCSAMKAEFTGHAEYLNALNDKRERLVKASRDVTMNSKKVIFQVHRISKNNKEEVLSKAENDLAAVVNQYIGKLVKELQGTDFWKLRRAYTPGVQEYIEAATFCRFCKTGTLLGLAEINDSLLALSDKSIEPLQINVLDYLLGVADLSGELMRLAIGRISDGEVEYAKNICAFVRDIYRELTLLVPLMDDNNEMKKKMEVMLQSVVKIENACFSVHVRGSEYIPMLGSSGEPDYAFFGAADYDQ

SEQ ID NO: 4584 - protein, 324 aa, Oryza sativa
MLPLRGCHRRLLSLRGVTAPSLLPPITTTPTTSMAAPQSHSHPAKTLRASPPPPSTAGSAPKRSRTMATDAAATAHSASAGCSAMKAEFAKHAEYLNTLNDKRERLVKASRDLTMNSKKAIFQVHRISKNNKEEVLSKAENDLTVVVNQYIGKLVKELQGTDFWKLRRAYTFGVQEYVEAATFCRFCKTGTLLSLAEINDSLLELGDKSVEPLQINVLDYVLGVADLSGELMRLAIGRISDGEVEYAKNICAFVRDIYRELTLVVPLMDDNSEMKKKMETMLQSVVKIENACFSVHVRGSEYIPLLGSSADPDYSFFGASDFDQ

SEQ ID NO: 4585 - protein, 311 aa, Hordeum vulgare
LRFCHRLVHLRGLPSSLRLPLPSTMAAPQPGCKTFRPGTTSLPSPAGPAPKRSRTMATDAAASPASAGCSAMKAEFTGHAEYLNALNDKRERLVKASRDVTMNSKKVIFQVHRISKNNKEEVLSKAENDLAAVVNQYIGKLVKELQGTDFWKLRRAYTPGVQEYIEAATFCRFCKTGTLLGLAEINDSLLALSDKSIEPLQINVLDYLLGVADLSGELMRLAIGRISDGEVEYAKNICTFVRDIYRELTLLVPLMDDNNEMKKKMEVMLQSVVKIENACFSVHVRGSEYIPMLGSSGESDYAFFGAADYDQ

SEQ ID NO: 4586 - protein, 262 aa, Zea mays
MANLFLKQAKQYVATRPVYPPELFDFIASKTPRRDMAWDVGTGNGQAAASLAKLYKHVVGTDTSAQQLAYATRLSNTRYVHTPADLPLEGIHATVAPPASVDLVTVAQAFHWLDLPRFYAQARSVLRPGHGVLAAWCYTEPRVNAAVDAVFWRLYHGSQGFWAPNRRMVDDEYRSADFPFDPVEGEKHTGPFQFSTHRRMDLDDYLMYITSWSAYQTAKDNGVELLDAPTVQEFAAAWGGDAKEVKTVTYPIFLRIGKVRSE

SEQ ID NO: 4587 - protein, 262 aa, Setaria italica
MANLFLKQAKQYVATRPSYPPELFDFIASKTPRRDLAWDVGTGNGQAAASLAKLYKAVVGTDTSAQQLAFAAPLPNVRYVHTAPDLPLDGIHAAVAGPGTADLITVAQAFHWLDLPRFYAQARSVLRPEQGVLAAWCYTEPRVSAAVDAVFWRLYRGSQPYWAPNRRMVDDEYRGADFPFDPVDGEAHTGPFEFSTERAMDLDGYLTYITSWSAYQTAKEKGVELLDEATVQEFAAAWGGDGKEVKAVTYPIFLRIGKVRAE

SEQ ID NO: 4588 - protein, 262 aa, Setaria italica
MANLFLKQAKQYVATRPSYPPELFDFIASKTPRRDLAWDVGTGNGQAAASLAKLYKAVVGTDTSAQQLAFAAPLPNVRYVHTAPDLPLDGIHAAVAGPGTADLITVAQAFHWLDLPRFYAQARSVLRPAQGVLAAWCYTEPRVSAAVDAVFWRLYRGSQPYWAPNRRMVDDEYRGADFPFDPVDGEAHTGPFEFSTERAMDLNGYLTYITSWSAYQTAKEKGVELLDEATVQEFAAAWGGDGKEVKAVTYPIFLRIGKVRAE

SEQ ID NO: 4589 - protein, 263 aa, Pennisetum glaucum
MANLFLKQAKQYVATRPSYPPELFDFIASKTPRRDLAWDVGTGNGQAAASLAKLYKAVVGTDTSSQQLAYAAPLPNVRYVLTPPDLPLDGIHAAVAGPGTADLVTVAQAFHWFDLPRFYKQVRSVLSPAQGVLAAWCYTEPRVSAAVDAVFWRLYCGSQPYWAPNRRMVDDEYRSADFPFDPVDGEVHTGPFEFSTERAMDLDDYLTYITSWSAYQTAKEKGVELLDEATVRDFAAAWGGDGKEVKAVTYPIFLRIGKVRVEE

SEQ ID NO: 4590 - protein, 260 aa, Triticum aestivum
MANLFLKQAKHYAAARPDYPAELFQFIASKTARHDLAWDVGTGSGQAAVSLAKLYKNVVGTDTSAQQLAYAPALPNVRYAHTPADLPLEGIHAAVAPPGSVDVVTVAQAFHWLDLPRFYAQARSLLRAHGVLAAWCYTEPRVGAAVDAVFWRLYDGSQPHWAPNRKMVDDEYRSADFPFDPVDGETHTGPFEFSTDRRMDLDDYFTYIKSWSAYQTAKDNGVELLDDATVQDFADAWGGDREEVKTVRYPIFLRIGKVRP

SEQ ID NO: 4591 - protein, 260 aa, Triticum aestivum
MANLFLKQAKHYAAARPDYPAELFQFIASKTARHDLAWDVGTGSGQAAVSLAKLYKNVVGTDTSAQQLAYAPALPNVRYAHTPADLPLDGIHAAVAPPGSVDVVTVAQAFHWLDLPRFYAQARSLLRAHGVLAAWCYTEPRVGAAVDAVFWRLYDGSQPHWAPNRKMVDDEYRSADFPFDPVDGETHTGPFEFSTDRRMDLDDYFTYIKSWSAYQTAKDNGVELLDDATVQDFADAWGGDREEVKTVRYPIFLRIGKVRP

SEQ ID NO: 4592 - protein, 266 aa, Hordeum vulgare
MANLFLKQAKHYAAARPDYPAELFQFIASKTARHDLAWDVGTGSGQAAVSLAKLYKKVVGTDTSAQQLAYAPALPNVRYAHTPADLPLEGIHAAVAPPGSVDVVTVAQAFHWLDLPRFYAQTRSLLRAHGVLAAWCYTEPRVGAAVDAVFWRLYNGSQPHWAPNRKMVDDEYRSADFPFDPVDGEDHTGPFEFSTERSMDLDDYFTYIKSWSAYQTAKDNGVELLDEDTVRAFADAWGDDRGEVKTVRYPIFLRIGKVRPESTDAA

SEQ ID NO: 4593 - protein, 269 aa, Avena sativa
MANLFLNQAKQYAATRPVYPLELFEFIASKTPRHDLAWDVGTGSGQAAASLATLYKDVVGTDTSAQQLAYAPRLPNTRYVHTPPDLPLEGIHEAVARPGTVDVATVAQAFHWLDLPRFYAQARSVLRAPPHGHGVLAAWCYTEPRVGAAVDEVFWRLYHGSQPHWAPNRRLVDDEYRSVDFPFDPVDGETHTGPFEFATERRMDLHDYLSYITSWSAYQTAKEKGVEMLDEATVKEFAEAWGGQREEVKTVRYPIFLRIGKVRPQSDDA

SEQ ID NO: 4594 - protein, 267 aa, Brachypodium distachyon
MANLFLKQAKQYAATRPAYPPELFEFIASKTARHDLAWDVGTGSGQAIAPLAKLYKEVVGTDTSAQQLSYAPPLPNVRYVHTPADLPLAGIHAAVAPPSSVDVITVAQAFHWLDLPRFYADARSVLRAPHGVLAAWCYTEPRVDAGGAVDAAFWRLYEASQPHWAPNRKMVDDEYRSVEFPFDPVDGEAHTGPFEFSTERRMDLDDYLTYISSWSAYQTAKDKGVELLDEATVREFAAAWGGDRGVVKTVRYPVFLRIGKVRPESDV

SEQ ID NO: 4595 - protein, 850 aa, Zea mays
MASDGGGSSPPPASSPYGRPSSPLAVTNSSPSQPTRRSGGRRRRGSASPYASSPSLGGFETPPHPGRRTPSGAGAGAPRQPRQNSTGRFPPTPSTPMSTDDVPPSSEAGDDETDGGGGVDATPVFVWGTNISVQDVNAAILRFLRHFRDPRDAGRVDPVMDEGKYMRAIHRILELEGGESLDVDAHDVFDHDPDLYSKMVRYPLEVLAIFDIVLMDLVARIEPLFEKHIQTRIYNLKSSICLRNLNPSDIEKMVSIKGMIIRCSSVIPELKEAVFRCLVCGFYSEPVMVDRGRVTEPHICQKEQCKATNSMTLVHNRCRFSDKQIIKLQETPDEIPEGGTPHTVSVLMHDKLVDAGKPGDRVEITGIYRAMSIRIGPTQRTVKSIFKTYIDCLHIKKTDKSRLHVEDTMDIDNSNASKSTEEDFLSDKVEKLKELSKLPDIYERLTRSLAPNIWELDDVKRGLLCQLFGGNPLKLPSGASFRGDINILLVGDPGTSKSQLLQYMHKLSPRGIYTSGRGSSAVGLTAYVTKDPETGETVLESGALVLSDKGVCCIDEFDKMSDNARSMLHEVMEQQTVSIAKAGIIASLNARTSVLACANPTESRYNPRLSVIDNIHLAPTLLSRFDLIYLILDKADEQTDRRLAKHIVSLHFENPNLEELEVLDLQTLVSYISYARKYIQPQLSDEAAEELTRGYVEMRKRGNSPGSRKKVITATARQIESLIRLSEALARMRFSEVVEVRDVVEAFRLLEVAMQQSATDHATGTIDMDLIMTGISASERQRRENLVAATRNLIAEKMQLGGPSMRMIELLEELRKQSSMEIHMHELRGALGTLMTEGAVVIHGDNVRRV

SEQ ID NO: 4596 - protein, 851 aa, Zea mays
MASNSGGNSPPSVPSSDGRPSSPLPVTHSSPSQPTRRSGGRRRRGSASPYASSPSLWGFETPPHPGRRTPSGAGAGAARQQRQNLSGRFPPTPSTPMSTDDVPPSSEAGDDETDGGDGGVDATPVFVWGTNISVQDVNAAILRFLRHFRDPRDAGRVDPVMDEGKYMRSIHRILELEGGESLDVDAHDVFDHDSDLYSKMVRYPLEVLAIFDIVLMDLVARIEPLFEKHIQTRVYNLKSSICLRNLNPSDIEKMVSIKGMIIRCSSVIPELKEAVFRCLVCGFYSEPVMVDRGRVTEPHICQKEQCKATNSMTLVHNRCRFSDKQIIKLQETPDEIPEGGTPHTVSVLMHDKLVDAGKPGDRVVITGIYRAMSIRVGPTQRTVKSIFKTYIDCLHIKKTDKSRLHVEDTKDIDNSNASKCTEEDFLSDKVEKLKELSKLPDIYDRLTRSLAPNIWELDDVKRGLLCQLFGGNPLKLPSGASFRGDINILLVGDPGTSKSQLLQYMHKLSPRGIYTSGRGSSAVGLTAYVTKDPETGETVLESGALVLSDKGVCCIDEFDKMSDNARSMLHEVMEQQTVSIAKAGIIASLNARTSVLACANPTESRYNPRLSVIDNIHLAPTLLSRFDLIYLILDKADEQTDRRLAKHIVSLHFENPNLEELEVLDLQTLVSYISYARKYIQPQLTDEAAEELTRGYVEMRKRGNSPGSRKKVITATARQIESLIRLGEALARMRFSEVVEVRDVVEAFRLLEVAMQQSATDHATGTIDMDLIMTGISASERQRRNDLVAATRNLIVEKMQLGGPSMHMIELLEELRKQSSMEIHLHELRGALGTLMTEGAVVIHGENVKRV

SEQ ID NO: 4597 - protein, 850 aa, Setaria italica
MASNGGGSSPPSASSPDARPSSPFPVTNSSPTQSTRRSGGRRRRGSASPYPSSPSLGGFETPPHPGRRTPSGAGAGAARQQRQNWTGRFPPTPSTPMSTDDIPPSSDAGDDETDGAGAGVDATPVFVWGTNISVQDVNAAILRFLRHFRDPRDAGRVDPVMDEGKYMRAIHRILELEGGESLDVDAHDVFDHDPDLYSKMVRYPLEVLAIFDIVLMDLVARIEPLFEKHIQTRIYNLKSSICLRNLNPSDIEKMVSIKGMIIRCSSVIPELREAVFRCLVCGFYSEPIMVDRGRVTEPHICQKEQCKATNSMTLVHNRCRFADKQIIKLQETPDEIAEGGTPHTVSVLMHDKLVDAGKPGDRVEITGIYRAMSIRVGPAQRTVKSIFKTYIDCLHVKKTDKSRLHVDTMDIDNSNANNSTEEDFLSDKVEKLKELSKLPDIYDRLTRSLAPNIWELDDVKRGLLCQLFGGNPLKLPSGASFRGDINILLVGDPGTSKSQLLQYMHKLSPRGIYTSGRGSSAVGLTAYVAKDPETGETVLESGALVLSDKGVCCIDEFDKMSDNARSMLHEVMEQQTVSIAKAGIIASLNARTSVLACANPTESRYNPRLSVIDNIHLAPTLLSRFDLIYLILDKADEQTDRRLAKHIVSLHFENPNLEELEVLDLPTLVAYISYARKYIQPQLSDEAAEELTRGYVEMRKRGNSPGSRKKVITATARQIESLIRLSEALARMRFSEVVEVRDVVEAFRLLEVAMQQSATDHATGTIDMDLIMTGISASERQRRENLVAATRNLIMEKMQLGGPSMRMTELLEEMRKQSSMEIQLHDLRGALGTLMTEGAVVIHGDNVKRV

SEQ ID NO: 4598 - protein, 862 aa, Oryza sativa
MASRGGGGGGDGNSPPPSVSSPDVRPSSPLPATNSSPPQSGRRGGGRRRRGSASPYPSSPSLGGFETPPHPGRRTPSGGAAARQQRQNWTGGRFPPTPSTPMSTDDVPLSSEAGDEDTPETDGGGGGGAGADATPVFVWGTNISVQDVNAAILRFLRHFRDPRDAGRVDPVMDEGKYMRAIHRILELEGGESLDVNAHDVFDHDPDLYGKMVRYPLEVLAIFDIVLMDLVARIEPLFEKHIQTRIYNLKSSVCLRNLNPSDIEKMVSIKGMIIRCSSVIPELKEAVFRCLVCGFYSEPVMVDRGRVTEPHICQKEQCKATNSMTLVHNRCRFADKQIIKLQETPDEIPEGGTPHTVSVLMHDKLVDAGKPGDRVEITGIYRAMSIRVGPTQRTVKSIFKTYIDCLHIKKTDKSRLHVEDSMETDNPNANKTTEDDFLRDKVEKLKELSKLPDIYDRLTRSLAPNIWELDDVKRGLLCQLFGGNALRLPSGASFRGDINILLVGDPGTSKSQLLQYMHKLSPRGIYTSGRGSSAVGLTAYVTKDPETGETVLESGALVLSDKGVCCIDEFDKMSDNARSMLHEVMEQQTVSIAKAGIIASLNARTSVLACANPTESRYNPRLSVIDNIHLPPTLLSRFDLIYLILDKADEQTDRRLAKHIVSLHFENPNIEELEVLDLPTLVAYISYARKHIQPQLSDEAAEELTRGYVEMRKRGNSPGSRKKVITATARQIESLIRLSEALARMRFSEMVEVQDVVEAFRLLEVAMQQSATDHATGTIDMDLIMTGISASERQRRDNLVAATRNLVMEKMQLGGPSVRMIELLEEIRKQSSMEVHLHDLRGALGTLMTEGAVVIHGDSVKRV

SEQ ID NO: 4599 - protein, 855 aa, Brachypodium distachyon
MATNRGGGNSSPPNNSVSSPDVRPSSPLPATNSSPPQSTRRAVGRRRRGSASPYPSSPSLGGFETPPPPGRSTPSGAGPTRQRQNWTGRFPPTPSTPMSTDDVPMSSEAGDEDTPETDGGGAGVDATPVFVWGTNISVQDVNAAILRFLRHFRDPRDAGRVDPVMDEGKYMRAIHRILELEGGESLDVDAHDVFDHDPDLYGKMVRYPLEVLAIFDIVLMDLVARIEPLFEKHIQTRIYNLKSSICLRNLNPSDIEKMVSIKGMIIRCSSVIPELKEAVFRCLVCGFYSEPVMVDRGRVTEPQRCQKEQCKATNSMTLVHNRCRFSDKQIIKLQETPDEIPEGGTPHTVSVLMHDKLVDAGKPGDRVEITGIYRAMSIRIGPSQRTVKSIFKTYIDCLHIKKTDKSRLHIEDGMDTDSTNASKTSEDDFVRDKIEKLKELSKLPDIYDRLTRSLAPNIWELDDVKRGLLCQLFGGNALRLPSGANFRGDINILLVGDPGTSKSQLLQYMHKLSPRGIYTSGRGSSAVGLTAYVAKDPETGETVLESGALVLSDKGVCCIDEFDKMSDNARSMLHEVMEQQTVSIAKAGIIASLNARTSVLACANPSESRYNPRLSVIDNIHLPPTLLSRFDLIYLILDKADEQTDRRLAKHIVSLHFENPDVEEHQVLDLPTLVAYISYARKYIEPQLSDEAAEELTRGYVEMRKRGNSPGSRKKVITATARQIESLIRLSEALARMRFSEVVGVRDVTEAFRLLEVAMQQSATDHATGTIDMDLIMTGISASERQRRDNLVAAIRNLVMEKMQLGGPSMRMIELLEELRQQSSMEVHLHDVRGALGTLMSEGTVVMHGDSFKRT

SEQ ID NO: 4600 - protein, 859 aa, Triticum aestivum
SLSGLSLRASHGVQRRRKQQLSLLCVVAGCPPVEPAPGHQLIPSPVRSPRRRPPPPRPHLVSLPRRVRDSAATGPPHSVRCWRSPAAPKLDRTVSANSVHSHVHRRRPAVLRSRGGGHARDRRRRRRRRCTPVFVWGTNISVQDVNAAILRFLRHFRDPRDAGRVDPVMDEGKYMRAIHRILELEGGESLDVDAHDVFDHDPDLYGKMVRYPLEVLAIFDIVLMDLVARMEPLFEKHIQTRIYNLKSSICLRNLNPSDIEKMVSIKGMIIRCSSVIPELKEAVFRCLVCGFYSEPVMVDRGRVTEPHICQKEQCKASNSMTLVHNRCRFADKQIIKLQETPDEIPEGGTPHTVSVLMHDKLVDAGKPGDRVEITGIYRAMSIRIGPSQRTVKSIFKTYIDCLHIKKTDKSRLHIEDSMDTDNTNASKSSEDGHVTDKIDKLKELSKLPDIYDRLTRSLAPNIWELDDVKRGLLCQLFGGNALRLPSGANFRGDINILLVGDPGTSKSQLLQYMHKLSPRGIYTSGRGSSAVGLTAYVAKDPETGETVLESGALVLSDKGVCCIDEFDKMSDNARSMLHEVMEQQTVSIAKAGIIASLNARTSVLACANPSESRYNPRLSVIDNIHLPPTLLSRFDLIYLILDKADEQTDRRLAKHIVSLHFENPEVVEHQVLDLPTLVAYISYARKYIQPKLSDEAAEELTRGYVAMRQRGNNPGSRKKVITATARQIESLIRLSEALARMRFSEVVGVRDVTEAFRLLEVAMQQSATDHATGTIDMDLIMTGVSASERQRRDNLVAAIRDLVMEKMQLGGPSMRMAELLEEVRKQSSMEVHQHDLRVALGTLQSEGSVFVHGDSFKRT

SEQ ID NO: 4601 - protein, 911 aa, Oryza sativa
MASRGGGGGGDGNSPPPSVSSPDVRPSSPLPATNSSPPQSGRRGGGRRRRGSASPYPSSPSLGGFETPPHPGRRTPSGGAAARQQRQNWTGGRFPPTPSTPMSTDDVPLSSEAGDEDTPETDGGGGGGAGADATPVFVWGTNISVQDVNAAILRFLRHFRDPRDAGRVDPVMDEGKYMRAIHRILELEGGESLDVNAHDVFDHDPDLYGKMVRYPLEVLAIFDIVLMDLVARIEPLFEKHIQTRIYNLKSSVCLRNLNPSDIEKMVSIKGMIIRCSSVIPELKEAVFRCLVCGFYSEPVMVDRGRVTEPHICQKEQCKATNSMTLVHNRCRFADKQIIKLQETPDEIPEGGTPHTVSVLMHDKLVDAGKPGDRVEITGIYRAMSIRVGPTQRTVKSIFKTYIDCLHIKKTDKSRLHVEDSMETDNPNANKTTEDDFLRDKVEKLKELSKLPDIYDRLTRSLAPNIWELDDVKRGLLCQLFGGNALRLPSGASFRGDINILLVGDPGTSKSQLLQYMHKLSPRGIYTSGRGSSAVGLTAYVTKDPETGETVLESGALVLSDKGVCCIDEFDKMSDNARSMLHEVMEQQTVSIAKAGIIASLNARTSVLACANPTESRYNPRLSVIDNIHLPPTLLSRFDLIYLILDKADEQTDRRLAKHIVSLHFENPNIEELEVLDLPTLVAYISYARKHIQPQLSDEAAEELTRGYVEMRKRGNSPGSRKKVITATARQIESLIRLSEALARMRFSEMVEVQDVVEAFRLLEVAMQQSATDHATGTIDMDLIMTGISASERQRRDNLVAATRNLVMEKMQLGGPSVRMIELLEEIRKQSSMEVHLHDLRGALGTLMTEGAVVIHGDSVKRKTPSFAANHVLVRINAIHSIAGLRSIRPFMWLLILSHRIGESILDGPDFF

SEQ ID NO: 4602 - protein, 824 aa, Hordeum vulgare
MASNGGGNSNSPYSPDVRPSSPLPATNSSPPQSARRAGGRLRRGPTSSPSLGGFETPPPPGRRIPSGAGAGRQRQNWTGRFPPTPSTPMSTDDVPPSSEAGEEDTPETDGGGVGADATPVFVWGTNISVQDVNAAILRFLRHFRDPRDAGRVDPVMDEGKYMRAIHRILELEGGESLDVDAHDVFDHDPDLYGKMVRYPLEVLAIFDIVLMDLVARMEPLFEKHIQTRIYNLKSSICLRNLNPSDIEKMVSIKGMIIRGSSVIPELKEAVFRCLVCGFYSEPVMVDRGRVTEPHICQKEQCKASNSMTLVHNRCRFADKQIIKLQETPDEIPEGGTPHTVSVLMHDKLVDAGKPGDRVEITGIYRAMSIRIGPSQRTVKSIFKTYIDCLHIKKTDKSRLHIEDSMDTDNTNASKSSEDSHVTDKIDKLKELSKLPDIYDRLTRSLAPNIWELDDVKRGLLCQLFGGNALRLPSGANFRGDINILLVGDPGTSKSQLLQYMHKLSPRGIYTSGRGSSAVGLTAYVAKDPETGETVLESGALVLSDKGVCCIDEFDKMSDNARSMLHEVMEQQTVSIAKAGIIASLNARTSVLACANPSESRYNPRLSVIDNIHLPPTLLSRFDLIYLILDKADEQTDRRLAKHIVSLHFENPEVVEHQVLDLPTLVAYISYARKFIQPKLSDEAAEELTRGYVEMRKRGNNPGSRKKVITATARQIESLIRLSEALARMRFSEVVGVRDVAEAFRLLEVAMQQSATDHATGTIDMDLIMTGVSASERQRRDNLVSAIRDLVMEKMQLGGPSMRMAELLEEVRKQSSMEVHQHDLR

SEQ ID NO: 4603 - protein, 758 aa, Secale cereale
MSTDDVPLSSEAGEDTPETDGGGVGADATPVFVWGTNISVQDVNAAILRFLRHFRDPRDAGRVDPVMDEGKYMRAIHRILELEGGESLDVDAHDVFDHDPDLYCKMVRYPLEVLAIFDIVLMDLVARMEPLFEKHIQTRIYNLKSSICLRNLNPSDIEKMVSIKGMIIRCSSVIPELKEAVFRCLVCGFYSEPVMVDRGRVTEPHICQKEQCKASNSMTLVHNRCRFADKQIIKLQETPDEIPEGGTPHTVSVLMHDKLVDAGKPGDRVEITGIYRAMSIRIGPSQRTVKSIFKTYIDCLHIKKTDKSRLHIEDSMDTNNTNDASKPSEDGLVTDKIDKLKELSKLPDIYDRLTRSLAPNIWELDDVKRGLLCQLFGGNALRLPSGANFRGDINILLVGDPGTSKSQLLQYMHKLSPRGIYTSGRGSSAVGLTAYVAKDPETGETVLESGALVLSDKGVCCIDEFDKMSDNARSMLHEVMEQQTVSIAKAGIIASLNARTSVLACANPSESRYNPRLSVIDNIHLPPTLLSRFDLIYLILDKADEQTDRRLAKHIVSLHFENPEVVEHQVLDLPTLVAYISYARKYIQPKLSDEAAEELTRGYVMMRQRGNNPGSRKKVITATARQIESLIRLSEALARMRFSEVVGVRDVTEAFRLLEVAMQQSATDHATGTIDMDLIMTGVSASERQRRDNLVAAIRDLVMEKMQLGGPFMRMAELLEEVRKQSSMEVHQHDLRVALGTLQSEGSVFVHGDSFKRT

SEQ ID NO: 4604 - protein, 859 aa, Triticum aestivum
SLSGLSLRASHGVQRRRKQQLSLLCVVAGCPPVEPAPGHQLIPSPVRSPRRRPPPPRPHLVPLPRRVRDSAATGPPHSVRCWRSPAAPKLDRTVSANSVHSHVHRRRPAVLRSRGGGHARDRRRRRRRRCTPVFVWGTNISVQDVNAAILRFLRHFRDPRDAGRVDPVMDEGKYMRAIHRILELEGGESLDVDAHDVFDHDPDLYGKMVRYPLEVLAIFDIVLMDLVARMEPLFEKHIQTRIYNLKSSICLRNLNPSDIEKMVSIKGMIIRCSSVIPELKEAVFRCLVCGFYSEPVMVDRGRVTEPHICQKEQCKASNSMTLVHNRCRFADKQIIKLQETPDEIPEGGTPHTVSVLMHDKLVDAGKPGDRVEITGIYRAMSIRIGPSQRTVKSIFKTYIDCLHIKKTDKSRLHIEDSMDTDNTNASKSSEDGHVTDKIDKLKELSKLPDIYDRLTRSLAPNIWELDDVKRGLLCQLFGGNALRLPSGANFRGDINILLVGDPGTSKSQLLQYMHKLSPRGIYTSGRGSSAVGLTAYVAKDPETGETVLESGALVLSDKGVCCIDEFDKMSDNARSMLHEVMEQQTVSIAKAGIIASLNARTSVLACANPSESRYNPRLSVIDNIHLPPTLLSRFDLIYLILDKADEQTDRRLAKHIVSLHFENPEVVEHQVLDLPTLVAYISYARKYIQPKLSDEAAEELTRGYVAMRQRGNNPGSRKKVITATARQIESLIRLSEALARMRFSEVVGVRDVTEAFRLLEVAMQQSATDHATGTIDMDLIMTGVSASERQRRDNLVAAIRDLVMEKMQLGGPSMRMAELLEEVRKQSSMEVHQHDLRVALGTLQSEGSVFVHGDSFKRT

SEQ ID NO: 4605 - protein, 277 aa, Saccharum officinarum
MAGIVVVFDFDKTIVDVDSDNWVVDNLGFTELFERLLPTMPWNTLMDTMMGELHAAGKTLGDVAEVLRAAPIDPRVPAAIKAAYALGCDLRVLSDANAFFIETILEHHGIRGCFSQINTNPSHVDADGRLRIGPYHAAPHGCGVGTCPPNMCKGQVLDRILREASASGTGLRKRVIYLGDGRGDYCPSLRLAREDFMMPRRGYPVWDLICEDPARLQAEVHPWADGAELEETLLRLVGRALVEEAALLPPLDCKLESTMPVAAQDAGMPIMPLGVKN

SEQ ID NO: 4606 - protein, 275 aa, Setaria italica
MAGIIVVFDFDKTIIDVDSDNWVVDSLGFTEEFERLLPTMPWNDLMDAMMGKIHAAGRTLDDVAAALRAVPIDPRVPAAIRAACALGCDLRVLSDANAFFIDTVLDHHGLRGCFTEVNTNPSRVDADGRLRIGPYHAAPHGCGVGTCPPNMCKGQVLDRILREAAAGGGRKRVIYLGDGRGDYCPSLRLAREDFVMPRRGFPVWDLICEDPARVQAEVHPWADGAEMEATLLGLVRRVLVEDAAALLPLDCKLESSIPVTAAQDGMPIMPLGVKN

SEQ ID NO: 4607 - protein, 276 aa, Zea mays
MAGVVVVFDFDKTIIDVDSDNWVVDSLGFTEPFERLLPTMPWNTLMDTMMGELHAHGRTLDDVAEALRAAPVVAGVPAAIKAAYALGCDLRVLSDANAFFIDTVLAHHGLLGCFSQINTNPSHPDADADGRLRIGPYHDLHGCGVGTCPPNMCKGQVLDRILREASSSAAGRKRVVYLGDGRGDYCPALRLAREDFVMPRRGFPVWDLICEDPARLQAEVHPWADGAELEETLLRLVGRARVEEAALLPPLDCKLESMPVAAQEGMGPIMPLGVKH

SEQ ID NO: 4608 - protein, 285 aa, Zea mays
MAGIVVVFDFDKTIIDVDSDNWVVDSLGLTDLFERLLPTTPWNTLMDTMMGELHARGRTLAEVTEALRAAPIDPRVPAAVRAAHALGCDLRVLSDANAFFIHTVLDHHGLLACFSQVNTNPSRVDAHGRLRIGPCHDPRAAPHGCGVGTCPPNMCKGLVLDRILREAEAEAETASSAKPRVIYLGDGRGDYCPALRLARTDFVMPRRGYPVWDLICEDPARLQAEVHPWTDGAELEETLLRLVRRAVVEDAALPPPPPPPLDCKLESMPVAAQDGMPIVPLGVKN

SEQ ID NO: 4609 - protein, 284 aa, Panicum virgatum
MPAGNGIVVVFDFDKTIIDVDSDNWVVDSLGLTEEFERLLPTMPWNTLMDTMMGELHARGRTLGDFAAALLAAPIDPRVPAAIRAAAALGCDLRVLSDANAFFIETVLEHHGLRGCFTEVNTNPSRVDAGGRLRIEPYHDFLRGAPHGCGVGTCPPNMCKGQVLDRILREAAAGGRKPRVIYLGDGRGDYCPALRLAREDFVMPRRGYPVWDLICEDPARVQAEVHPWADGAEMEATLLALVRRALVEDAAAAALLPLDCKLESSIPAAAQDGGMPIMPLGVKN

SEQ ID NO: 4610 - protein, 280 aa, Pennisetum glaucum
MAAAGIIVVFDFDKTIIDVDSDNWVVDSLGFTEEFERLLPTMPWNDLMDAMMGQIHAHGKTLDGDVAAALRAVPIDPRVPHAIRAARALGCDLRVLSDANAFFIDTVLDHHGLRGCFTEVNTNPSLADADGRLRIGPYHAAPHGCGVGTCPPNMCKGLVLDRILREAAAAPGGRKRVIYLGDGRGDYCPSLRLGREDFVMPRRGFPVWDLICEDPARVQAEVHPWADGAEMEATLLGLVRRVLVEDAAAALLPLDCKLESSMPAAATQDGMPIMPLGVKN

SEQ ID NO: 4611 - protein, 108 aa, Zea mays
MRREGRQHGWVFTVDPSLVDAEGKCRSRAVQVEGAAAANGGFVRASRKPTNHSKPAVGRAYKSLIGKGEAGSGKQGRHKFKHDEVKMYSLYLEGAHDAYADAMLEFDS

SEQ ID NO: 4612 - protein, 401 aa, Zea mays
MQAAVNTTTVGAHPHPTKSSFLRPSPPCRVYFHASPRPNLRAIAMASKSQLQDQLIITRPDDWHLHLREGGVLEAVVPHSARHFGRAIIMPNLKPPVTTTARAVEYREEIMRALPPGSSFEPLMTLYLTDNTSPEEIKLARKSGIIFAVKLYPAGATTNSQDGVTDIFGKCLPVLEEMVRQEMPLLVHGEVTDPHVDTFDREKVFIDKILAPLVQKLPQLKIVMEHITTMDAVNFIESCEEGHVAATVTPQHLLLNRNALFQGGLQPHNYCLPVLKRETHRQAIVSAVTNGSRRYFLGTDSAPHDKRNKECSCGCAGIYSAPVALSLYVKVFEEAGALDKLEAFTSFNGPDFYGLPRNTSKIILRKNAWKVPATYKHSSGEIVPMFNGSTLEWLPSDQPKE

SEQ ID NO: 4613 - protein, 403 aa, Setaria italica
MQAASTTTTVRTHTHTNPLSASFLQLPPPRRVSFHASPRLSLRATAMAATSQQQEEQLIITRPDDWHLHVREGSVLEAVLPHSARHFGRAIIMPNLKPPVTTTARALEYREEIMKALPPGSSFEPLMTLYLTDNTSPEEIKLGRKSGVVFAVKLYPAGATTNSQDGVTDIGKCMPVFEEMVRQEMPLLVHGEVTDPHVDTFDREKVFIDRILAPLVQKLPQLKIVMEHITTMDAVNFIESCEEGHVAATVTPQHLLLNRNALFQGGLQPHNYCLPVLKRETHRQAILSAVTSGSKRYFLGTDSAPHDKRNKERYCGCAGIYSAPVALSLYAKVFEEAGALDKLEAFTSFNGPDFYGLPRNTSKIVLKKSAWKVPATYTYSSGEIVPMFTGCTLKWLPSDQTEE

SEQ ID NO: 4614 - protein, 406 aa, Oryza sativa
MQTAATSTFFANPHVKHLPGPFLRPSPHYGALVHLPSFRNKTPISIAMAASPSPPPLQELTITRPDDWHLHLREGDVLAAVLPHSAMHFGRAIVMPNLKPPVTTTARALEYREEILRALPPGSNFVPLMTLYLTDNTSPEEIKLAKKSGVVFAVKLYPSGATTNSQDGVTDIFGKCLPVLEEMARQEMPLLVHGEVTDQHVDTFDREKVFIEKILAPLVQRLPQLKIVMEHITTMDAVNFVESCKEGHVAATVTPQHLLLNRNALFQGGLQPHNYCLPVLKRETHRQAIVSAVTSGSKQYFLGTDSAPHDKRRKECSCGCAGIYSAPVALSLYAKVFEQAGALDKLEAFTSFNGPDFYGLPRNTSKIVLRKSAWKVPDTYSYSSGEIVPMFTGNTLEWLPSDQLEE

SEQ ID NO: 4615 - protein, 400 aa, Secale cereale
MQAAITTTASANPHLKPLVSLLRPSPPHRVRVHPPRHRLNTRASAMASSAPQELTITRPDDWHLHLRDGDVMAAVLPHSARHFQRAIVMPNLKPPVTTTARAIAYRDEILKALPPGSSFVPLMTLYLTDRTSPEEIKIARKSGVVFAVKLYPAGATTNSQDGVTDILGKCLPVLEEMVKQEMPLLVHGEVTDPHVDTFDREKVFIEKILAPLVQKLPQLKIVMEHITTMDAVNFVESCKEGHVAATVTPQHLLLNRNALFQGGLQPHNYCLPVLKRETHRQAIVSAVTSGSRQYFLGTDSAPHDKRMKECSCGCAGIYSAPVALSLYAKVFEEAGALDKLEAFTSFNGPDFYGLPRNTSKIVLRRSPWKVPATYTYGSGVIVPMSTGNTLEWLPSDQPEE

SEQ ID NO: 4616 - protein, 400 aa, Hordeum vulgare
MQAAITATVSANPHLKPLVSLLRPSPAHRVRTHLPRHRPNTRASAMATSTPQELTITRPDDWHLHLRDGDVLAAVLPHSARHFERAIVMPNLKPPVTTTARAIAYRDEILKALPPGSSFVPLMTLYLTDSTSPEEIKIARKSGVVFAVKLYPAGATTNSQDGVTDILGKCLPVLEEMVKQEMPLLVHGEVTDPHVDTFDREKVFIERILAPLVQKLPQLKIVMEHITTMDAVNFVESCKEGHVAATVTPQHLLLNRNALFQGGLQPHNYCLPVLKRETHRQAIVSAVTSGSRQYFLGTDSAPHDKRMKECSCGCAGIYSAPVALSLYAKVFEQAGALDKLEAFTSFNGPDFYGLPRNTSKIVLRRSPWKVPATYAYGSGVIVPMSTGNTLEWLPSDQPEE

SEQ ID NO: 4617 - protein, 402 aa, Brachypodium distachyon
MQAAITDSISAHSRPNPSVCFLRLSHPHRVRIHPTSHRRNTRARAMAASVPSPQQLTITRPDDWHLHLRDGDVLAAVLPHSARHFERAIVMPNLKPPVTTTARAVEYREEILRALPPGSSFVPLMTLYLTDNTSPEEIKLARKSGVVFAVKLYPAGATTNSQDGVTDIMGKCLPVLEEMIRQEMPLLVHGEVTDPHVDTFDREKVFIETILAPLVQKLPELKIVMEHITTMDAVNFVESCKEGHVAATVTPQHLLLNRNALFQGGLQPHNYCLPVLKRETHRQAIVSAVTSGSRQYFLGTDSAPHDKRMKECSCGCAGIYSAPVALSLYAKAFEQAGTLDKLEAFTSFNGPDFYGLPRNTSKIVLRRSAWKVPTTYTYGSGVIVPMSTGNTLEWLPSDHSEE

SEQ ID NO: 4618 - protein, 400 aa, Triticum aestivum
MQFAITTAVSANPHLKPLVSFPRPSPPHRVRVHPPCHRLNTRASVMASSSPLELTITRPDDWHLHLRDGDVMATVLPHSARHFERAIVMPNLKPPVTTTARAIAYRDEIMKALPPGSSFVPLMTLYLTDSTSPEEIKIARKSGAVFAVKLYPAGATTNSQDGVTDILGKCLPVLEEMVKQEMPLLVHGEVTDPHVDTFDREKVFIEKILAPLVQKLPQLKIIMEHITTMDAVNFVESCKEGHVAATVTPQHLLLNRNALFQGGLQPHNYCLPVLKRETHRQAIVSAVTSGSRQYFLGTDSAPHDKRMKECSCGCAGIYSAPVALSLYAKVFEEAGALDKLEAFTSFNGPDFYGLPRNTSKTVLRRSPWKVPATYAYGSGVIVPMSTGNTLEWLPSDQPEE

SEQ ID NO: 4619 - protein, 357 aa, Setaria italica
MAATSQQQEEQLIITRPDDWHLHVREGSVLEAVLPHSARHFGRAIIMPNLKPPVTTTARALEYREEIMKALPPGSSFEPLMTLYLTDNTSPEEIKLGRKSGVVFAVKLYPAGATTNSQDGVTDIGKCMPVFEEMVRQEMPLLVHGEVTDPHVDTFDREKVFIDRILAPLVQKLPQLKIVMEHITTMDAVNFIESCEEGHVAATVTPQHLLLNRNALFQGGLQPHNYCLPVLKRETHRQAILSAVTSGSRRYFLGTDSAPHDKRNKERYCGCAGIYSAPVALSLYAKVFEEAGALDKLEAFTSFNGPDFYGLPRNTSKIVLKKSAWKVPATYTYSSGEIVPMFTGCTLEWLPSDQTEE

SEQ ID NO: 4620 - protein, 357 aa, Setaria italica
MAATSQQQEEQLIITRPDDWHLHVREGSVLEAVLPHSARHFGRAIIMPNLKPPVTTTARALEYREEIMKALPPGSSFEPLMTLYLTDNTSPEEIKLGRKSGVVFAVKLYPAGATTNSQDGVTDIGKCMPVFEEMVRQEMPLLVHGEVTDPHVDTFDREKVFIDRILAPLVQKLPQLKIVMEHITTMDAVNFIESCEEGHVAATVTPQHLLLNRNALFQGGLQPHNYCLPVLKRETHRQAILSAVTSGSKRYFLGTDSAPHDKRNKERYCGCAGIYSAPVALSLYAKVFEEAGALDKLEAFTSFNGPDFYGLPRNTSKIVLKKSAWKVPATYTYSSGEIVPMFTGCTLKWLPSDQTEE

SEQ ID NO: 4621 - protein, 396 aa, Zea mays
MTGSSRRSCSCSRRAAGPRRSGGGSSSSRGGTARRGRAPRRRTARAPRPWRSRPHSGATWQARRNYRSLRGLIRLQGVMRGASVRRQTAQAMRCMQTLVRVQAQVRASRVEAMERRNRQHHGAMLRDGGRWRASSQDGGFWDASRLTREEADARTKRKVEAVIKRERALAYAYSHQLLKATPMAAHAILADLQSGRSPWWWTPIERRHEPGAYRPADPAIRKPLPALAIAHRDMTTTPVAMTAATTPARSVVSAYSKTRATRPVIRVGAPPPSNHSHVGSIRDDESLTSCPAFGGVPNYMTPTMSASAKARARAHLQEQQKNKAAQEKPRFSFGLGQSIGSWAKSPFWKAAVPSSRVATPAASMAGGRHRSTRSISGLSTDSTVSMPARLGTRSFK

SEQ ID NO: 4622 - protein, 557 aa, Setaria italica
MGKKGSWFTALKKAFTPSPKEKPTNVHQLVAQYPPAHGHAREKKRWGSFGRPRPHAEPASPAAGALINIPLYREPSSIEKILGDAEMDQQRQYYAATRAQYQITPARPTTTAVAASAAAPLPQPVAAARERERERGREDKPAAVVLPLPPPSPPPLIRRFDHDREQQQKLQQLQQQSRAETEWRQPQPRRHRAARQRAAPPDRARAAAVAIQAAFRGYMARRNYRSLRGLIRLQGVMRGASVRRQTAQAMRCMQTLVRVQAQVRASRVDAMERRNRQHHGAMLRDGGRWRAGSQDGGIWDDSRLTREEADARTKRKVEAVIKRERALAYAYSHQLLKATPMAAHAILADLQSGRSPWWWTPIERRHEPEGAYYRPVDPVSKPRPALSIAHREMTTPTMPMTAATTPARSVVSAYSKPRSARPSKGAGAAPPPLSHAGSMSIRDDESLTSCPAFGVGGVPNYMTPTLSASAKARARAQLLLQQQQQKAAQEKPRFSFGLGQSIGSWAKSPFWKAPSSSRVGTPAASVAGGGRHRRSISGLSVDSTVSMPAGLGRRPIK

SEQ ID NO: 4623 - protein, 553 aa, Panicum virgatum
MGKKGNWFTALKKAFTSSPKEKPSNVHQLVAQYPPPHGHAREKKRWGGFGRSRPYAEPASPAAGALINIPLYREPSSIEKILGDEEMDQQRQYYAATRAQYQITAARPAAVAVSAASAAAPLPQPVATARERERERRRDDKPAAVVLPLPPPSPPPLIRRFDHDREQQQKLQQLQQHSRAETEWRHQQPPRRHRAARQRAAPPDRARAAAVAIQSAFRGYMARRNYQSLRGLIRLQGVMRGASVRRQTAHAMRCVQTLVRVQAQVRASRVEAMERRNRQHHGAMLRDGGRWRAGSQDGGIWDDSRLTPEEADARTKRKVEAVIKRERALAYAYSHQLLKATPMAAHAILADLQSGRSPWWWTPIERRHEPEAAYRPVDPASKPRPALATAHRGMMTPTAMTTAAATPARSVVSAYSNSKPRSTRPAPAKGAGSVSIRDDESLTSCPAFGGVPNYMTPTLSASAKARARAQLLLQQQQQQQQKAAQEKPRFSFGLGQGIGSWAKSPFWKAPSSRVGTPAASVAGGRHRPTRSISGLSVDSTVSMPAGIGRRPFK

SEQ ID NO: 4624 - protein, 388 aa, Panicum virgatum
MGKKGSWFTALKKAFTSSPKEKPTNVHQLVAQYPPPHGHAREKKRWGGFGRSRPYAEPASPAAGALINIPLYREPSSIEKILGDEEMDQQRQYYAATRAQYQITPARPTAAAVAVSAASAAAPLPQPVATARERVRERSRDDKPAAVVLPLPPPSPPPLIRRFDHDREQQQKLQQLQQHSRAETEWRQQPPRRHRAARQRTAPPDRARAAAVAIQSAFRGYMARRNYQSLRGLIPAAGRDAGRQRAAADGARDAVHADAGPRAGAGARQPRRGHGAAQPAAPRRHAQGRRQVARRLTGRRHLGRQPADAAGGGRADEAEGGGRDQARESPRLRLLASAAEGDADGGPRDPGGPAVGPGAPGGGRPSSAATSRRRPTAPSRSPANPARL

SEQ ID NO: 4625 - protein, 221 aa, Setaria italica
MGKKGSWFTALKKAFTPSPKEKPTNVHQLVAQYPPAHGHAREKKRWGSFGRPRPHAEPASPAAGALINIPLYREPSSIEKILGDAEMDQQRQYYAATPDHAGQAHHNRRRRSLPQPVAAARERERERGREDKPAAVVLPLPPPSPPPLIRRFDHDREQQQKLQQLQQQSRAETEWRQPQPRRHRAARQRAAPPDRARAAADPGRVPGLHGKRGGTTGRCAG

SEQ ID NO: 4626 - protein, 506 aa, Saccharum officinarum
EPASPAAGALINIPLYREPSSIEKILGDAEMDQQRQYYAATRAQYQITPARPTTAVAASAAATLPQPVVGTARERERERSREDKLASVVLPLPPPSPPPLIRRFDHDREQQQKLQQLQLQLQLQSRAETEWRQQQQQPRRHRAARQRAAPPDRARAAAVAIQSAFRGYMARRNYRSLRGLIRLQGVMRGASVRRQTAQAMRCMQTLVRVQAQVRASRVEAMERRNRQHHSAMLRDGGRWRAGSQDGGIWDDSRLTREEADARTKRKVEAVIKRERALAYAYSHQLLKATPMAAHAILADLQSGRSPWWWTPIERRHEPGDYRPVEPASSKPRPAFTIARRETTTTTPMAMTAATTPARSVVSAYSKTRSTRPVTKVGAPAPPLSHAGSIRDDESLTSCPAFGGVPNYMTPTLSASAKARARAHLQQQQQKAAQEKPRFSFGLGQSIGSWAKSPFWKAGAGGLPSSRVATPAASVAGGRHRSTRSISGLSVDSTVSMPAGLGRRPFK

SEQ ID NO: 4627 - protein, 523 aa, Zea mays
MEDWLFYSLTTLLCLLCSLILRARTPGKKARNADSSSPLPPLPPGPTPLPVLGPLLFLARRDFDIEPVLRRIARDHGKVFTFAPLGRARPGIFVADRGAAHRALVQRGAAFASRPPSTASSAVLTSGGRNVSSSPYGATWRALRRNLASGVLNPARLRAFSPARRWVLGVLARRVRADGRHGEAPVAVMEPFQYAMFCLLVHMCFGGDRLGDDARVRDIEATQRELLGSFLSFQVFSFLPWVTKLVFRRRWEKLVSLRRRQEELFVPLIQARREAGGDGDSYVDSLVKLTIPEDGGRPLTDGEIVSLCSEFLSAGTDTTATALQWILANLVKNPAMQDRLRDEVSSAGAGADGEVLEEELQAMPYLKAVVLEALRRHPPGHYVLPHAVHEDTTLDGYRVPAGAPVNFAVGDIGMDEEVWRAPAEFRPERFLPGGEGDDVDLTGSKEIKMMPFGAGRRVCPGMALALLHLEYFVANLVREFDWRQADGEEVDLTEKLEFTVVMKRPLRARAVPLRPPPPAVAAA

SEQ ID NO: 4628 - protein, 528 aa, Setaria italica
MEDWLFYSLTTLLCLLCSLLLRAGRARSLGGSKAHAAADSLPPLPPGPAPLPVLGPLLFLARRDFDVEPALRRIARDHGPVFTFAPLGRSRPTIFVAGRAAAHRALVQRGAAFASRPPTTGAGVVLTSGGRNVSSAPYGATWRALRRNLASGVLNPARLRGAFSPARRWVLDVLVSRVRSDGRGGESPVPVMEPFQYAMFCLLVYMCFGGDRVVDDDDARVRDIEATQRELLANFLSFQVFSFLPSVTKLVFRRRWEKLVSLRRRQEELFLPLIEARRDAGADGDCYVDSLLKLTIPEDGGRALTNGEIVSLCSEFLSAGTDTTATALQWVLANLVKNPEMQGRLRDEVAGVVGAAAGEVREEDLQAMPYLKAVVLEALRRHPPGHFLLPHAVHEDTTLDGYRVPAGAPVNFAVGDIGLDGEVWDAPSEFRPERFLPGGEGEDVDLTGSKEIKMMPFGAGRRVCPGMALALMHLEYFVANLVREFEWREADGEEVDLAEKLEFTVVMKRPLKARAVPLRSPPPTVAAA

SEQ ID NO: 4629 - protein, 518 aa, Setaria italica
MEDWLFYSLTMLLCLLCSLLLRARARSPSKINATDESLPPLPPGPAPLPVVGPLLFLARRDFDMEPMLRRITREYGPVFTFAPLGKARPTIFVAARGAVHRALVQRGVMFASRPPVTASGIVLTSGGRNISSSPYGTTWRTLRRNLAAGVLNPARLRAFSPARRWVLDILVSRVRTDGGNGERPVTVMEPFQYAMFCLLVYMCFGDHLEDARVRDIEATQRELLSNFLSFQVFSFVPAVTKIVFRRRWEKLILLRRRQEELFVPLIQARREAGADGDCYVDSMVKLIIPEDSGRTLTDDEIVSLCSEFLSAGTDTTATTLQWILANLVKNQAMQDRLRDEVASSVGANGKVREDNLQAMPYLKAVVLEGLRRHPPGHYVLPHAVHEDTTLDGYRVPAGTPVNFAVGDIGLDEEVWDAPSEFRPERFLPGGEGEEVDLTGSKEIKMIPFGAGRRVCPGMALALLHLEYFVANLVREFKWLEADGEDVDLTEKLEFTVVMKRPLKARAVPLRSPSVVAAA

SEQ ID NO: 4630 - protein, 521 aa, Hordeum vulgare
MEDWLFYSLTTMLCLLSSLLLRARARSPSHSATLTPQTPPLPPGPVPLPVLGPLLHLARRDFDLEPVLRVLARAYGPVYSFAPLGLARPMIFVAARGPAHRALVQQGAAFASRPRATAPAAAVLTSGGRNVSSAPYGPTWRALRRTLASGVLNPARLRAFAPARRWVLDVLVSRIRSGGRGGGGVVAVMEPFQYAMFCLLVYMCFGGDRLGDARVRDIEALQRDLLGNFLSFQVFSFLPPLTKLVFRRRWSKLVSLRRRQEELFVPLIRARREAGAGGDCYVDSLVRLAIPEDGGRGLTDGEIVSLCSEFLSAGTDTTATALQWILANLVKNPAMQDRLRDEVSAAVDGELREEDLQGMPYLKAVVLEGLRRHPPGHYVLPHAAAEETTLDGYRVPAGTPVNFAVGDIGLDEEIWTAPSEYRPERFLPGGEGEDVDLTGSKEIKMMPFGAGRRVCPAMALALLHLEYFVANLVREFEWREEAGEEVDLTEKLEFTVVMRRPLKARAVPLRQGRPIAATGSG

SEQ ID NO: 4631 - protein, 479 aa, Setaria italica
PLPVLGPLLFLARRDFDVEPALRRIARDHGPVFTFAPLGRSRPTIFVAGRAAAHRALVQRGAAFASRPPTTGAGVVLTSGGRNVSSAPYGATWRALRRNLASGVLNPARLRGAFSPARRWVLDVLVSRVRSDGRGGESPVPVMEPFQYAMFCLLVYMCFGGDRVVDDDDARVRDIEATQRELLANFLSFQVFSFLPSVTKLVFRRRWEKLVSLRRRQEELFLPLIEARRDAGADGDCYVDSLLKLTIPEDGGRALTNGEIVSLCSEFLSAGTDTTATALQWVLANLVKNPEMQGRLRDEVAGVVGAAAGEVREEDLQAMPYLKAVVLEALRRHPPGHFLLPHAVHEDTTLDGYRVPAGAPVNFAVGDIGLDGEVWDAPSEFRPERFLPGGEGEDVDLTGSKEIKMMPFGAGRRVCPGMALALMHLEYFVANLVREFEWREADGEEVDLAEKLEFTVVMKRPLKARAVPLRSPPPTVAAA

SEQ ID NO: 4632 - protein, 152 aa, Setaria italica
MAGMGDMPMRPARPGPPLQHRGPPPMARLRPEPIDREKTCPLLLRVFTRVAGHHQNEEFAVRGKEPKDEVQIYTWKDATLRELTDLVKEVALPARKRNARLSFAFVYPDKNGRFVVRQVGSTFAYGHGRGDDAKTLAELGFQIGDYLSVAIM

SEQ ID NO: 4633 - protein, 152 aa, Panicum virgatum
MAGMGEMPMRPARPGPPMQHRGPPPMARLRPEPIDREKTCPLLLRVFTRVAGHHQNEEFAVRGKEPKDEVQIYTWKDATLRELTDLVKEVALPARKRNARLSFAFVYPDKNGRFVVRQVGSTFAYGHGRGDDAKTLAELGFQIGDYLSVAIM

SEQ ID NO: 4634 - protein, 152 aa, Zea mays
MAGMTDMPMRPARPGPPMQHRGPPPMARLRPEPIDREKTCPLLLRVFTRVAGHHQNEEFSVRGKEPKDEVQIYTWKDATLRELTDLVKEVALPARKRNARLSFAFVYPDKNGRFVVRQVGSTFAYGHGRGDDAKTLAELGFQIGDYLSVAIM

SEQ ID NO: 4635 - protein, 150 aa, Cynodon dactylon
MAGMGDMPMRPRPGPPMQHRGPPPMARHRPEPIDREKTCPLLLRVFTRVAGHHDKEEFAVRGKEPKDEVQIYTWKDATLRELTDLVKEVALPARKRNARLSFAFVYPDKNGRFVVRPVGTTFAYGGRGDDTKTLAELGFQIGDYLSVAIL

SEQ ID NO: 4636 - protein, 152 aa, Oryza sativa
MAGRGEMPMRPVRPGPPMQYRGPPPMARARVEPVDREKTCPLLLRVFTKVGGHHQNEEFAVRGKEPKDEVQIYTWKDATLRELTDLVKEVALAARKRNARLSFAFVYPDKHGRFVVKEVGSTFSYGHGRGDDAKTLAELGFQIGDYLSVAIY

SEQ ID NO: 4637 - protein, 150 aa, Hordeum vulgare
MAGMGEMPMRPRPGPPMHRGPPPMARPRPEPIDREKTCPLLLRVFTKVGGHHLNEEFSERGKEPKDEVQIYTWKDATLRELTDLVKEVALPARKRNARLSFAFVYPDKNGRFVVKQVGSTFSYSHGRGDDAKSLGDLGFQIGDYLSVSIM

SEQ ID NO: 4638 - protein, 151 aa, Brachypodium distachyon
MAGMGEMHMRPRPGPPMQHRGPPPMARARPEPIDREKTCPLLLRVFTKVGAHHLNEDFATRGKEPKDEVQIYTWKDATLRELTDLVKEVALPARKRNARLSFAFVYPDKNGRFVVKQVGSTFSYGHGRGDDAKSLADLGFQIGDYLSVSIQ

SEQ ID NO: 4639 - protein, 150 aa, Triticum aestivum
MAGMGEMSMRPRPGPPMHRGPPPMARPRPEPIDREKTCPLLLRVFTKVGGHHLNEEFSERGKEPKDEVQIYTWKDATLRELTDLVKEVALPARKRNARLSFAFVYPDKNGRFVVKQVGSTFSYGHGRGDDAKSLGDLGFQIGDYLSVSIM

SEQ ID NO: 4640 - protein, 150 aa, Avena sativa
MAGMGEMPMRPRPGPPMQHRGPPPMARARPEPIDREKTCPLLLRVFTKVGGHHLNEDFSERGKEPKDEVQIYTWKDATLRELTDLVKEVALPARRRNARLSFAFVYPDKNGRFVVKQVGSTFSYGGRGDDAKSLGDLGFQIGDYLSVSIQ

SEQ ID NO: 4641 - protein, 147 aa, Secale cereale
MAGMGDMQMRPRPMHRGPPPMARPRPEPIDREKTCPLLLRVFTKVGGHHLNEEFSERGKEPKDEVQIYTWKDATLRELTDLVKEVALPARKRNARLSFAFVYPDKNGRFVVKQVGSTFSYGHGRGDDAKSLGDLGFQIGDYLSVSIM

SEQ ID NO: 4642 - protein, 223 aa, Panicum virgatum
MTAMPPLRHRGAAKKPMWIIVLLSLVCVALMGAYVYPPRRYSACYFFASSVCTPFKDWLPNVAREKTDEEIISAVVIRDLLSMPMPVSKHPKIAFMFLTPGSLPFEKLWEKFLQGHDGRYSIYIHASREKPVHSSSLFVGREIHSEKVVWGRISMVDAEKRLLANALEDVDNQFFVLLSDSCVPLHTFDYIYNYLMGTNVSFIDCFLDPGPHGTGKVFHGNAS

SEQ ID NO: 4643 - protein, 377 aa, Zea mays
MTAMPHPRHRGAAKKPMWIIVLLSLVCVALMGAYVYPPRRYSACYFFASSVCTPFKDWLPAVARERTDEEIVSSVVIRDLLSMPMAMSKNPKIAFMFLTPGSLPFEKLWEKFLQGHDGRYSIYIHASREKPVHSSSLFVGREIHSEKVVWGRISMVDAEKRLLGNALEDVDNQFFVLLSDSCVPLHTFDYIYNYLMGTNVSFIDCFFDPGPHGTGRYTMEMLPEIEQRDFRKGAQWFAITRRHALLILADNLYYNKFKLYCKPAEGRNCIADEHYLPTLFNMVDPGGIANWSVTHVDWSEGKWHPRSYRAADVTYQLLKNITSVNENVHITSDDKKVVTQTPCMWNGTKRPCYLFARKFYPESLNNLLKLFSSYTSA

SEQ ID NO: 4644 - protein, 375 aa, Pennisetum glaucum
MTAMPPTRHRGAAKKPMWIIVLLLLVCVALMGAYVYPPRRYSACYFFASSVCTPFKDWLPNVARERTDEEIVSSVVTRDLLSMPMPVSKNPKIAFMFLTPGSLPFEKLWEKFLQGHDGRYSIYIHASREKPVHSSSLFVGREIRSEKVVWGRISMVDAEKRLLANALEDVDNQFFVLLSDSCVPLHKFDYMYNYLMGTNVSFIDCFLDPGPHGTGRYSMEMLPEIEQRDFRKGAQWFAITRRHALLILADNLYYNKFKLYCKPAEGRNCIADEHYLPTLFNMVDPGGIANWSVTHVDWSEGKWHPRSYRAADVTYELLKNITSVNESFRITSDDKKVATVTPCVWNGTKRPCYLFARKFYPETLNNLLKLFSSYT

SEQ ID NO: 4645 - protein, 377 aa, Setaria italica
MTAMPPPRHRGAAKKPMWIIVLLSLVCVALMGAYVYPPRRYSACYFFASSVCTPFKDWLPNVARERTDEEIVSSVVNRDLLSMPMPVSKNPKIAFMFLTPGSLPFEKLWEKFLQGHDGRYSIYIHASREKPVHSSSLFVGREIRSEKVVWGRISMVDAEKRLLANALEDVDNQFFILLSDSCVPLHTFDYIYNYLMGTNVSFIDCFLDPGPHGTGRYSTEMLPEIEQRDFRKGAQWFAITRRHALLILADNLYYNKFKLYCKPAEGRNCIADEHYLPTLFNMVDPGGIANWSLTHVDWSEGKWHPRSYRAADVTYELLKNITSVSENFHITSDDKKVATVAPCMWNGTKRPCYLFARKFYPETLNNLLKLFSSYTSA

SEQ ID NO: 4646 - protein, 377 aa, Setaria italica
MTAMPPPRHRGAAKKPMWIIVLLSLVCVALMGAYVYPPRRYSACYFFASSVCTPFKDWLPNVARERTDEEIVSSVVNRDLLSMPMPVSKNPKIAFMFLTPGSLPFEKLWEKFLQGHDGRYSIYIHASREKPVHSSSLFVGREIRSEKVVWGRISMVDAEKRLLANALEDVDNQFFILLSDSCVPLHTFDYIYNYLMGTNVSFIDCFLDPGPHGTGRYSTEMLPEIEQRDFRKGAQWFAITRRHALLILADNLYYNKFKLYCKPAEGRNCIADEHYLPTLFNMVDPGGIANWSLTHVDWSEGKWHPRSYRAADVTYELLKNITSVSENFHITSDDKKVVTVAPCMWNGTKRPCYLFARKFYPETLNNLLKLFSSYTSA

SEQ ID NO: 4647 - protein, 377 aa, Zea mays
MTTMPPPRHRGAAKKPMWIIVLLSLVCVALMGAYVYPPRHYSACYFFASSVCTPFKDWLPAVVRERTDEEIVSSVVIRNLLSMPMAVSKNPKIAFMFLTPGSLPFEKLWEEFLQGHDGRYSIYIHASREIPVHSSSLFVGREIRSEKVVWGRISMVDAEKRLLANALEDVDNQFFVLLSDSCVPVHTFDYIYNYLMGTNVSFIDCFLDPGPHGTGRYSMEMLPEIEQRDFRKGAQWFAITRRHALLILADNLYYNKFKLYCKPAEGRNCIADEHYLPTFFNMVDPGGIANWSVTHVDWSEGKWHPRSYRAADVTYELLKNITSVNENFRITSDDKKVVTRIPCMWNGTKRPCYLFARKFYPESLNNLLKLFSSYTSA

SEQ ID NO: 4648 - protein, 390 aa, Oryza sativa
MKASQVWQRGSKDMTAMPPPRQRGAAKKPMWIIVLLSLVCVALIGAYAYPPRRYSACYFFASSVCTPFKDWLPTVTRRERTDEEIVSSVVMRDLLAMPMPVSKNPKIALMFLTPGSLPFEKLWEKFLQGHEDRYSIYIHASRERPVHSSSLFVGREIHSEKVVWGRISMVDAEKRLLANALEDVDNQFFVLLSDSCVPLHTFDYIYNFLMGTNVSFIDCFLDPGPHGSGRYSVEMLPEIEQRDFRKGAQWFAVTRRHALLILADHLYYNKFELYCKPAEGRNCIADEHYLPTLFNMVDPGGISNWSVTHVDWSEGKWHPRSYRAIDVTYALLKNITAIKENFRITSDDKKVVTMTPCMWNGTKRPCYLFARKFYPEALNNLLKHSSYTST

SEQ ID NO: 4649 - protein, 391 aa, Brachypodium distachyon
MKVSKVWPRSSKDMTAMPPPRHRGAAKKPMWIIVLLSMVCVSLIGAYVYPPRRYSACYFFASSVCTPFKDWLPAVTRREKTDGEIISSVVMRDLLSMPMPVSKKPKIAFMFLTPGSLPFEKLWEKFLQDHEGRYSIYIHASREKPVHSSSLFVNREIHSERVVWGRVSMVDAEKRLLANALEDVDNQFFVLLSDSCVPLHRFDYIYNYLMGTNVSFIDSFLDPGPHGTGRYSMEMLPEIEQRDFRKGAQWFAIKRRHALLILADSLYYRKFKLYCKPAEGRNCIADEHYLPTLFKMVDPGGISNWSVTHVDWSEGKWHPRSYRAADITYELLKNITSFDENLHITSDDTKAVTMTPCILNGTKRPCFLFARKFYPEALNNLLKLFSSYTSA

SEQ ID NO: 4650 - protein, 378 aa, Hordeum vulgare
MTVMPPARHRPAAKRPMWIIVLLCLVCVVLIGAYVYPPRHYSQCYLSASSVCTPFKDWLPSIGRRERTDDEVISAAVIRDILGMPMSTSKSPKIAFMFLTPGSLPFEKLWEKFLQGHEGRYSIYVHASRQKPVHSSSLFVGRDIHSDAVVWGKISMIDAEKRLLANALEDADNQFFVLLSDSCVPLHSFDYVFNYLMGTNISFIDCFQDPGPHGNGRYSLEMLPEIEERDFRKGAQWFAITRRHALLILADNLYYKKFKLYCKPADGRNCIADEHYLPTLFNMVDPGGIANWSVTHVDWSEGKWHPRSYAAADVSYDLLKNITAVDETIHVTSDDKKVVTQKPCLWNGSKSPCYLFARKFYPETLDSLLKIFTSYTSV

SEQ ID NO: 4651 - protein, 378 aa, Secale cereale
MTVMPPARHRPAAKRPMWIIVLLCLVCVVLIGAYVYPPRHYSQCYLSASSVCTPFKDWLPSIGRREKTDDEIISAAVIRDILGMPMSASKNPKIAFMFLTPGSLPFEKLWEKFLQGHEGRYSIYVHASRQKPVHSSSLFVGRDIHSDAVVWGKISMIDAEKRLLANALEDADNQFFVLLSDSCVPLHSFDYVFNYLMGTNISFIDCFQDPGPHGNGRYSLEMLPEIEERDFRKGAQWFAITRRHALLILADNLYYKKFKLYCKPADGRNCIADEHYLPTLFNMVDPGGIANWSVTHVDWSEGKWHPRSYGVADVSYDLLKNITAVDETIHVTSDDKKLVTQKPCLWNGSKSPCYLFARKFYPETLDSLLKIFTSYTSV

SEQ ID NO: 4652 - protein, 390 aa, Secale cereale
MKVSRVWQRGSKDMTAMPHPRHRTAKKPMWIIVLLSIVCVSLIGAYVYPPRRYSTCYFFASSVCTPFKDWLPAVTRREPTDQEVFSSVVIRDLLSMPMPVSKNPKIAFMFLTPGSLPFEKLWEKFLQGHEGRYSIYIHASREKPVHSSPLFVGREIRSEKVVWGRVSMVDAEKRLLGNALLDIDNQFFVLLSDSCIPLHTFDYIYNYLMGTNVSFIDSFLDPGPHGSGRYSIEMFPEIEHRDFRKGAQWFAITRRHAILIMADSLYYRKFKLYCKPTVGRNCIADEHYLPTLFKIVDPGGISNYSVTHVDWSEGKWHPRSYRAADITYELLRNITYFNEIVHIASDETRTVTSTPCILNGRKRPCFLFARKFYPDAVNNLLKLFPSYTSA

SEQ ID NO: 4653 - protein, 390 aa, Triticum aestivum
MKVPRVWQRGSKDMTAMPHPRHRTAKKPMWIIVLLSIVCVSLIGAYVYPPRRYSTCYFFASSVCTPFKDWLPAVTRREPTDQEVFSSVVIRDLLSMPMPVSKKPKIAFMFLTPGSLPFEKLWENFLQGHEGRYSIYIHASREKPVHSSPLFVGREIRSEKVVWGRVSMVDAEKRLLGNALLDIDNQFFVLLSDSCIPLHTFDYIYNYLMGTNVSFIDSFLDPGPHGSGRYSIEMFPEIEHRDFRKGAQWFAITRRHAILIMADNLYYRKFKLYCKPTVGRNCIADEHYLPTLFKIVDPGGISNYSVTHVDWSEGKWHPRSYRAADITYELLRNITYFNEIVHIASDETRTVTSTPCILNGRKRPCFLFARKFYPDAVNNLLKLFPSYTSA

SEQ ID NO: 4654 - protein, 378 aa, Oryza sativa
MTVMPSLRHRAVAKKPKWIIILVSLVCFVLIGAYVFPPRRYSQCYLFGSGACATFKDWLPSVTRRERTDEEIISSVVLRDILAMPMPVSKNPKIALMFLTPGTLPFEKLWEKFLQGQEGRYSIYVHASREKPVHTSSLFVGRDIHSDAVVWGKISMVDAEKRLLANALADVDNQFFVLLSDSCVPLHTFDYVYNYLMGTNISFIDCFRDPGPHGNGRYSPEMLPEIEEKDFRKGAQWFAITRRHALLILADSLYYKKFKLYCKPADGRNCIADEHYLPTLFNMVDPGGIANWSVTHVDWSEGKWHPRSYRAADVTYDLLKNITAVDENFHVTSDDKKLMTQKPCLWNGSKRPCYLFARKFYPETLDNLLKLFTSYTSV

SEQ ID NO: 4655 - protein, 390 aa, Hordeum vulgare
MKVPRVWQRGSKDMTAMPHPRHRTAKKPMWIIVLLSIVCVSLIGAYVYPPRRYSTCYFFASSVCTPFKDWLPAVTRREPTDQEIFSSVVIRDMLSMPMPMSKNPKIAFMFLTPGSLPFEKLWEKFLQGHEGRYSIYIHASREKPVHSSPLFVNREIRSEKVVWGRVSMVDAEKRLLGNALLDIDNQFFVLLSDSCIPLHTFDYIYNYLMGTNVSFVDSFLDPGPHGSGRYSIEMFPEIEHRDFRKGAQWFAITRRHAILIMADNLYYRKFKLYCKPTVGRNCIADEHYLPTLFKIVDPGGITNYSVTHVDWSEGKWHPRSYRAADITYELLRNITYFNEIVHIASDETRTVTSTPCILNGRKRPCFLFARKFYPDAVNNLLKLFPSYTSA

SEQ ID NO: 4656 - protein, 390 aa, Triticum aestivum
MKVSRVWQRGSKDMTAMPHPRHRTAKKPMWIIVLLSIVCVSLIGAYVYPPRRYSTCYFFASSVCTPFKDWLPAVTRRELTDQEVFSSVVIRDLLAMPMPVSKKPKIAFMFLTPGSLPFEKLWERFLQGHEGRYSIYIHASREKPVHSSPLFVGREIRSEKVVWGRVSMVDAEKRLLGNALLDIDNQFFVLLSDSCIPLHTFDYIYNYLMGTNVSFIDSFLDPGPHGSGRYSIEMFPEIEHRDFRKGAQWFAITRRHAILIMADNLYYRKFKLYCKPTVGRNCIADEHYLPTLFKIVDPGGISNYSVTHVDWSEGKWHPRSYRAADITYELLRNITYFNEIVHIASDETRTVTSTPCILNGRKRPCFLFARKFYPDAVNNLLKLFPSYTSA

SEQ ID NO: 4657 - protein, 378 aa, Triticum aestivum
MTVMPPARHRPAAKRPMWIIVLLCLVCVVLIGAYVYPPRHYSQCYLSASSVCTPFKDWLPSIGRREKTDDEIISAAVIRDILGMPMSTSKNPKIAFMFLTPGSLPFEKLWEKFLQGHEGRYSIYVHASRQKPVHTSSLFVGRDIHSDAVVWGKISMIDAEKRLLANALEDADNQFFVLLSDSCVPLHSFDYVFNYLMGTNISFIDCFQDPGPHGNGRYSLEMLPEIEERDFRKGAQWFAITRRHALLILADNLYYKKFKLYCKPADGRNCIADEHYLPTLFNMVDPGGIANWSVTHVDWSEGKWHPRSYAVADVSYDLLKNITAVDETIHVTSDDKKLVTQKPCLWNGSKSPCYLFARKFYPETLDSLLKIFTSYTSV

SEQ ID NO: 4658 - protein, 378 aa, Secale cereale
MTVMPPARHRPAAKRPMWIIVLLCLVCVVLIGAYVYPPRHYSQCYLSASSVCTPFKDWLPSIGRREKTDDEVISAAVIRDILGMPMSTSKSPKIAFMFLTPGSLPFEKLWEKFLQGHEGRYSIYVHASRQKPVHSSSLFVGRDIHSDAVVWGKISMIDAEKRLLANALEDADNQFFVLLSDSCVPLHSFDYVFNYLMGTNISFIDCFQDPGPHGNGRYSLEMLPEIEERDFRKGAQWFAITRRHALLILADNLYYKKFKLYCKPADGRNCIADEHYLPTLFNMVDPGGIANWSVTHVDWSEGKWHPKSYGVADVSYDLLKNITAVDETIHVTSDDKKLVTQKPCLWNGSKSPCYLFARKFYPETLDSLLKIFTSYTSV

SEQ ID NO: 4659 - protein, 378 aa, Zea mays
MTVMMPQRHRATAKKPMWIIVLLCMVCIVLIGAYVFPPRRFSNCYLSASSVCAPFKDWLPSMGRRERTDEEIISSVVIRDILSMPMPMPKNPKIALMFLTPGSLPFEKLWEKFLQGHEGRYSIYVHASREKPVHTSSLFAGRDIHSDAVVWGLISMVDAEKRLLANALEDVDNQVFILLSDSCVPLHSFDYVYNYLMGTNVSFIDCFKDPGPHGSGRYSIEMYPEIDERDFRKGAQWFAVTRRHALMILADSLYYKKFKLYCKPAEGRNCIADEHYLPTLFNMVDPGGISNWSVTHVDWSEGKWHPRSYSADDVTYDLLKNITAVDENFHVTSDDKKLVMQKPCLWNGSKRPCYLFARKFNPEALDNLLKQFTSYTSV

SEQ ID NO: 4660 - protein, 379 aa, Setaria italica
MTVMMPQRHRAAAKKPMWIIVLLSMVCLVLIGAYVFPPRRYSKCYLFASSVCTPSFKDWLPSMGRRERTDEEIISSVVIRDILSMPMPVSKNPKIALMFLTPGSLPFEKLWEKFLQGHEGRYSIYVHASREKPVHTSSLFAGRDIHSDAVVWGLISMVDAEKRLLANALEDVDNQFFVLLSDSCVPLHSFDYVYNYLMGTNVSFVDCFKDPGPHGSGRYSIEMFPEINERDFRKGAQWFAVTRRHALMILADSLYYKKFKLYCKPAEGRNCIADEHYLPTLFNMVDPGGISNWSITHVDWSEGKWHPRSYSAADVTYDLLKNITAIDENFHVTSDDKKLVMQKPCLWNGSKRPCYLFARKFNPEALDNLLKLFTSYTSV

SEQ ID NO: 4661 - protein, 379 aa, Pennisetum glaucum
MTVMMPQRHRAAAKKPMWIIVLLSMVCLVLIGAYVFPPRRYSKCYLFASSVCTPSFKDWLPSMGRRERTDEEIISSVVIRDILSMPMPVPKNPKIALMFLTPGSLPFEKLWEKFLQGHEGRYSIYVHASREKPVHTSPLFSGRDIHSDAVVWGLISMVDAEKRLLANALEDVDNQFFVLLSDSCVPLHSFDYVYNYLMGTNVSFIDCFKDPGPHGSGRYSPEMFPEIVERDFRKGAQWFAITRRHALMILADSLYYKKFKLYCKPAEGRNCIADEHYLPTLFNMVDPGGISNWSVTHVDWSEGKWHPRSYSAADVTYDLLKNITAIDENIHVTSDDNKLMMQKPCLWNGSKRPCYLFARKFNPEALDNLLKLFTSYTSV

SEQ ID NO: 4662 - protein, 378 aa, Brachypodium distachyon
MTVMPPQRNRPAAKKPMWIIVLLCMVCVMLIGAYVYPPRKYSQCYLSASSVCTSFKDWLPSIGRREKTDEEIISAAVMKDILAMPMSASKSPKIALMFLTPGSLPFEKLWEKFLQGHEGRYSIYVHASRQKPVHSSSLFVGRDIHSDAVVWGKISMIDAEKRLLANALEDADNQFFVLLSDSCVPLHSFDYVYNYLMGTNISFVDCFQDPGPHGNGRYSLEMLPEIEERDFRKGAQWFAITRRHALLILADNLYYKKFKLYCKPADGRNCIADEHYLPTLFNMVDPGGIANWSVTHVDWSEGKWHPRSYRAEDVTYDLLKNITAVDENFHVTSDDQKLVTQKPCLWNGSKSPCYLFARKFYPETVDNLLKIFTSYTSV

SEQ ID NO: 4663 - protein, 378 aa, Sorghum bicolor
MTVMIPQRHRATAKKPMWIIVLLSMVCIVLIGAYVFPPRRFSKCYLSASSVCTNFKDWLPSMGHRERTDEEIISSVVIRDILSMPMPVSKNPKIALMFLTPGSLPFEKLWEKFLQGHEGRYSIYVHASREKPVHTSSLFAGRDIHSDAVVWGLISMVDAEKRLLANALEDVDNQVFILLSDSCVPLHSFDYVYNYLMGTNVSFVDCFKDPGPHGSGRYAPEMYPEIDERDFRKGAQWFAVTRRHALMILADNLYYKKFKLYCKPAEGRNCIADEHYLPTLFNMVDPGGISNWSVTNVDWSEGKWHPRSYSADDVTYDLLKNITAIDENIHVTSDDKKLVMQKPCLWNGSKRPCYLFARKFNPEALDNLLKLFTSYTSV

SEQ ID NO: 4664 - protein, 69 aa, Panicum virgatum
MADWGPVVVGVVLFVLLSPGLLCELPGSHRHVDFGGFHTNGKAIFVHTLIFFAAFTILTLALHVHIYTG

SEQ ID NO: 4665 - protein, 69 aa, Zea mays
MADWGPVVVGVVLFVLLSPGLLCELPGTHRHVDFGGFHTNGKAIFVHTLVFFAAFTILTLALHIHIYTG

SEQ ID NO: 4666 - protein, 69 aa, Oryza sativa
MADWAPVVVGVVLFVLLSPGLLVELPGTHRHVDFGSFRTNGKAIFVHTLIFFAAFAILTLALHLHIYTG

SEQ ID NO: 4667 - protein, 69 aa, Secale cereale
MADWAPVVVGVVLFVLLSPGLLFEMPGSHRHVDFGGFHTNGKAIFVHTLLFFAAFTILTLALHIHIYAG

SEQ ID NO: 4668 - protein, 93 aa, Triticum aestivum
  misc_feature (24)..(24): Xaa can be any naturally occurring amino acid
  misc_feature (32)..(32): Xaa can be any naturally occurring amino acid
  misc_feature (50)..(50): Xaa can be any naturally occurring amino acid
  misc_feature (58)..(59): Xaa can be any naturally occurring amino acid
  misc_feature (64)..(64): Xaa can be any naturally occurring amino acid
  misc_feature (71)..(71): Xaa can be any naturally occurring amino acid
  misc_feature (73)..(73): Xaa can be any naturally occurring amino acid
  misc_feature (75)..(76): Xaa can be any naturally occurring amino acid
  misc_feature (88)..(89): Xaa can be any naturally occurring amino acid
MADWGPVVVGVVLFVLLSPGLLCXLPGTHRHXDFGGFHTNGKAIFVQTLXLLRRLHHXXARAPXSHLQRLXSXVXXYVASVWTRGGLXXEKNP

SEQ ID NO: 4669 - protein, 69 aa, Unknown
  Sequence found in Organisms: Secale cereale, Triticum aestivum
MADWAPVVVGVVLFVLLSPGLLFEMPGSHRHVDFGGLHTNGKAIFVHTLLFFAAFTILTLALHIHIYAG

SEQ ID NO: 4670 - protein, 69 aa, Festuca arundinacea
MADWGPVVVGVVLFILLSPGLLFEIPGSHRHVDFGSFRTNGKAIFVHTLIFFAAFTILTLALHIHIYAG

SEQ ID NO: 4671 - protein, 69 aa, Brachypodium distachyon
MADWGPVVIGVVLFILLSPGLLFEIPGSHRHVDFGSFRTNGKAIFIHTLIFFAAFTILTLALHIHIYAG

SEQ ID NO: 4672 - protein, 69 aa, Elaeis guineensis
MADWAPVLVGVVLFVLLSPGLLFELPGTHRAVDLGGFHTNGKAVAVHTLIFFAVFTIIILALHLHIYTG

SEQ ID NO: 4673 - protein, 69 aa, Triticum aestivum
MADWAPVVVGVVLFILLSPGLLLEMPGSHRHVDFGGLHTNGKAIFVHTILFFAAFTVLTLALHIHIYAG

SEQ ID NO: 4674 - protein, 69 aa, Hordeum vulgare
MADWGPVVVGVVLFILLTPGLLFEMPGSHHRVDFGGLHTNGKAIFVHTILFFAAFTILTLALHIHIYAG

SEQ ID NO: 4675 - protein, 69 aa, Elaeis guineensis
  misc_feature (15)..(15): Xaa can be any naturally occurring amino acid
  misc_feature (69)..(69): Xaa can be any naturally occurring amino acid
MADWAPVLVGVVLFXLLSPGLLFELPGTHRAVDLGGFHTNGKAVAVHTLIFFAVFTIIILALHLHIYTX

SEQ ID NO: 4676 - protein, 365 aa, Zea mays
MGAASPAMWAGLVLVVLLAASGPASAGLPRFAEAPEYRNGDGCPAPVTGAGVCDPGLVHIAMTLDAHYLRGSMAAIYSLLKHASCPESIFFHFLAAEGGGAPAVAELRAAVAASFPSLRFEIYPFRADAVAGLISASVRAALEAPLNYARNHLADLLPRCVPRAIYLDSDVLAVDDVRRLWETRLPAAAVVAAPEYCHANFSRYFTEAFWDDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKSYDLYIGENDSSPASGPSRSALSSLVAW

SEQ ID NO: 4677 - protein, 366 aa, Zea mays
MGAASPAMWAGLVLVALLAVSGPAVAAGLPRFAEAPEYRNGEGCPAPVAGAGVCDPGLVHIAMTLDAHYLRGSMAAIYSLLKHASCPESLFFHFLAAAEGGGAPAASGLRAVVAASFPSLSFEIYPFRADAVAGLISASVRAALEAPLNYARNHLAGLLPRCVPRAIYLDSDVLAVDDVRWLWETRLPAAAVVAAPEYCHANFSRYFTDAFWDDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKAYDLYIGENDSSSSGPSRSALSSLAAW

SEQ ID NO: 4678 - protein, 142 aa, Zea mays
MAMCTRPGSQTPAPATGAGHPSPFLYSGASANLGSPAATAGPDTANNATSTSPAHIAGEAAPMATAAEGTPLGPRPGRPTARARLGGVGSGCVVPSLEVVGALVYAPTRRCARPVASAPFAGRLLDLDGSSIGRPGRFVGDI

SEQ ID NO: 4679 - protein, 374 aa, Setaria italica
MGAATPAMWAGLVLAAMLLLAQSGPAAAAGLPRFAEAPEYRNGEGCLAPVAGAGVCDPGLVHIAMTLDAHYLRGSMAAIYSLLKHASCPESLFFHFLAAEGGGAPPVADLRAAVAASFPSLRFEIYPFRADAVAGLISASVRAALEAPLNYARNHLADLLPRCVPRAIYLDSDVLAVDDVRRLWETRLPAAAVVAAPEYCHANFSRYFTEAFWNDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKSYDLYIGENDSSASGQSRSALSSSAALPAAVFSW

SEQ ID NO: 4680 - protein, 303 aa, Setaria italica
MWAGLVLAAMLLLAQSGPAAAAGLPRFAEAPEYRNGEGCLAPVAGAGVCDPGLVHIAMTLDAHYLRGSMAAIYSLLKHASCPESLFFHFLAAEGGGAPPVADLRAAVAASFPSLRFEIYPFRADAVAGLISASVRAALEAPLNYARNHLADLLPRCVPRAIYLDSDVLAVDDVRRLWETRLPAAAVVAAPARQLLPLLHRGLWNDPSSRAGLRPGAAARPATSTPGSWSSTSGDGASATTASASSAGWRCRKRRESTSSAPCPRSCSSSPARLRPSTTGGTSTAWAATTCSAAAAPSTTVPSA

SEQ ID NO: 4681 - protein, 370 aa, Panicum virgatum
MGAASPAMWAGLVLAALLLAQSAAGALPRFAEAPEYRNGEGCPAPVAGAGVCDPGLVHIAMTLDAHYLRGSMAAIYSLLKHASCPESLFFHFLAAGGGGAPPVADLRAAVAASFPSLRFEIYPFRADAVAGLISASVRAALEAPLNYARNHLADLLPRCVPRAIYLDSDVLAVDDVRRLWETRLPAAAVVAAPEYCHANFSRYFTEAFWNDPVLGARVFAGRRRAPCYFNTGVMVIDLRRWRVGNYRQRIERWMEMQKEKRIYELGSLPPFLLVFAGEIEAVDHRWNQHGLGGDNVFGSCRPLHNGPVSLMHWSGKGKPWDRLDAGKPCPLDHTWKSYDLYIGENDSSASWQSRSSLSSSAALPAGVFSW

SEQ ID NO: 4682 - protein, 312 aa, Avena sativa
MGGAAPGMWAGLVLVAFLAASGAGASAGGALPRFAEAPEYRNGEGCPAPVAGAGVCDPGLVHIAMTLDAHYLRGSMAAIYSLLKHASCPESLFFHFLAADAAAPGVGELRSALAASFPSLRFEIYPFRADAVTGLISASVRAALEAPLNYARNYLADLLPKCVPRAIYLDSDVLAVDDVRRLWETRLPAAAVVAAPEYCHANFSRYFTDAFWSDPELGARVFAGRRRAPCYFNTGVMVIDLRRWRSGNYRHRIEQWMELQKEKRIYELGSLPLSCSSSPVRWRLSTIGGISTVWAVTTCSVAAVPSTRVLSA

SEQ ID NO: 4683 - protein, 379 aa, Brachypodium distachyon
MGGASPAMRAGWVLVAFILAASGPGAAVVALPRFAEAPEYRNGDGCPAAVAGAGVCDPGLVHIAMTLDAHYLRGSMAAIYSLLKHASCPESLFFHFLAAADGGGPGAGAPEVGELRSALAASFPSLRFEIYPFRADAVTGLISASVRAALEAPLNYARNHLADLLPRCVPRAIYLDSDVLAVDDVRRLWETRLPAAAVVAAPEYCHANFSRYFTDAFWSDPDLGARVFAGRRRAPCYFNTGVMVIDLRRWRSGNYRHRIEQWMELQKEKRIYELGSLPPFLLVFAGEVEAVDHRWNQHGLGGDNVLGSCRPLHKGPVSLMHWSGKGKPWDRLDAGRPCPLDHTWKSYDLYVDDGDASSASAPSRTSLSSSALPAAVFSW

SEQ ID NO: 4684 - protein, 375 aa, Triticum aestivum
MAAAAPAMRAGLVLVAFLLLAASGAGARAEGALPRFAEAPEYRNGEGCPAAVAGAGVCDPGLVHIAMTLDAHYLRGSMAAIYSLLKHASCPESLFFHFLAADGAAPGVAELRSALAASFPSLRFEIYPFRADAVTGLISASVRAALEAPLNYARNYLADLLPKCVPRAIYLDSDVLAVDDVRRLWETRLPAAAVVAAPEYCHANFSRYFTDAFWSDPDLGARVFAGRRRAPCYFNTGVMVIDLRRWRSGNYRHRVEQWMELQKEKRIYELGSLPPFLLLFAGEVEAVDHRWNQHGLGGDNILGSCRPLHKGPVSLMHWSGKGKPWDRLDAGRPCPLDHTWKSYDLYIGDGDASQASAPSWASLSSSALPAAVFSW

SEQ ID NO: 4685 - protein, 356 aa, Secale cereale
MAAPAMWALAAFLVLAAVGGGAAGALPRFAEAPEYRNGEGCPAAVAGAGVCDPGLVHIAMTLDAHYLRGSMAAIYSLLKHASCPESLFFHFLAAAPGDGELRAALAASFPSLRFEIYPFRAEAVAGLISASVRAALEAPLNYARNHLADLLPPCVPRAIYLDSDVLAADDVRRLWETRLPAAAVVAAPEYCHANFSRYFTPAFWADPALGARVFADRRRPPCYFNTGVMVIDLRRWRAGNYRRRIERWMEIQKEKRIYELGSLPPFLLVFAGEVEAVDLRWNQHGLGGDNVHGSCRPLHDGPVSLMHWSGKGKPWDRLDAGRPCPLDHTWKSYDLYIPGDGSSAASPASGPALSAW

SEQ ID NO: 4686 - protein, 367 aa, Oryza sativa
MRAGLALVVVVVAVVVGDVGAALPRFAEAPEYRNGEGCPAAVAGAGVCDPGLVHIAMTLDAHYLRGSMAAIYSLLKHASCPESIFFHFLAAADGGEGCGGGVGELRTAVAASFPSLRFEIYPFRADAVTGLISASVRAALEAPLNYARNYLADLLPKCVPRAIYLDSDVLAVDDVRRLWETRLPAAAVVAAPEYCHANFSRYFTETFWSDPQLGDRVFAGRRRAPCYFNTGVMVIDLRRWRVGNYRRRIEVWMELQKEKRIYELGSLPPFLLVFAGEVEAVDHRWNQHGLGGDNVLGSCRPLHKGPVSLMHWSGKGKPWDRLDAGKPCPLDHTWKSYDLYIAEGDSSSASAPFALSSSALPAAAFSW

SEQ ID NO: 4687 - protein, 355 aa, Triticum aestivum
MRAAGAAVALLFFFLLAVPGEAAAALPRFAEAPQYRNGEGCPAATAAGVCDPGLVHIAMTLDAHYLRGSMAAIYSLLKHASCPESLFFHFLAAAPGDGELRAALAASFPSLRFEIYPFRAEAVAGLISASVRAALEAPLNYARNHLADLLPPCVPRAIYLDSDVLAADDVRRLWETRLPAAAVVAAPEYCHANFSRYFTPAFWSDPALGARVFADRRRPPCYFNTGVMVIDLRRWRAGNYRRRIERWMEIQKEKRIYELGSLPPFLLVFAGEVEAVDLRWNQHGLGGDNVHGSCRPLHDGPVSLMHWSGKGKPWDRLDAGRPCPLDHTWKSYDLYIAGDGSSAASPASGPALSAW

SEQ ID NO: 4688 - protein, 367 aa, Oryza sativa
MRAGLALVVVVVAVVVGDVGAALPRFAEAPDYRNGEGCPAAVAGAGVCDPGLVHIAMTLDAHYLRGSMAAIYSLLKHASCPESIFFHFLAAADGGEGCGGGVGELRTAVAASFPSLRFEIYPFRADAVTGLISASVRAALEAPLNYARNYLADLLPKCVPRAIYLDSDVLAVDDVRRLWETRLPAAAVVAAPEYCHANFSRYFTETFWSDPQLGDRVFAGRRRAPCYFNTGVMVIDLRRWRVGNYRRRIEVWMELQKEKRIYELGSLPPFLLVFAGEVEAVDHRWNQHGLGGDNVLGSCRPLHKGPVSLMHWSGKGKPWDRLDAGKPCPLDHTWKSYDLYIAEGDSSSASAPFALSSSALPAAAFSW

SEQ ID NO: 4689 - protein, 367 aa, Sorghum bicolor
MGGAAMWAAALAATVVFLAVEVSGAAGALPRFAEAPEYRNGEGCPAAAAGVCDPGLVHIAMTLDAHYLRGSMAAVYSLLKHASCPESIFFHFLAAEADGEEDPEPELLRRAVAASFPSLRFEIYPFRAEAVAGLISASVRAALEAPLNYARNHLADLLPRCVPRAIYLDSDVLAADDVRRLWETRLPAAAVVAAPEYCHANFSRYFTPAFWSDPELGARVFAGRRRPPCYFNTGVMVIDLRRWRAGNYRQRIERWMEIQKVKRIYELGSLPPFLLVFAGEVEAVDHRWNQHGLGGDNVHGSCRPLHAGPVSLMHWSGKGKPWDRLDAGRPCPLDHTWKSYDLYIPSDSSGAASPASGPALSASVLSW

SEQ ID NO: 4690 - protein, 356 aa, Secale cereale
MRAAGAAVALLFLFAAAVAVPGEAAALPRFAEAPQYRNGEGCPAATAAGVCDPGLVHIAMTLDAHYLRGSMAAIYSLLKHASCPESLFFHFLAAAPGDGELRAALAASFPSLRFEIYPFRAEAVAGLISASVRAALEAPLNYARNHLADLLPPCVPRAIYLDSDVLAADDVRRLWETRLPAAAVVAAPEYCHANFSRYFTPAFWADPALGARVFADRRRPPCYFNTGVMVIDLRRWRAGNYRRRIERWMEIQKEKRIYELGSLPPFLLVFAGEVEAVDLRWNQHGLGGDNVHGSCRPLHDGPVSLMHWSGKGKPWDRLDAGRPCPLDHTWKSYDLYIPGDGSSAASPASGPALSAW

SEQ ID NO: 4691 - protein, 374 aa, Setaria italica
MGGAAGEAMRAGVAVAAAVFLAFAFSGAAAALPRFAEAPEYRNGEGCPAAAAGVCDPGLVHIAMTLDAHYLRGSMAAVYSLLKHASCPESIFFHFLAAEAGAAGGEGPEPEPELLRRAVAASFPSLRFEIYPFRAEAVAGLISASVRAALEAPLNYARNHLADLLPRCVPRAIYLDSDVLAADDVRRLWETRLPAAAVVAAPEYCHANFSRYFTPAFWSDPDLGARVFAGRRRPPCYFNTGVMVIDLRRWRAGNYRQRIERWMEIQKEKRIYELGSLPPFLLVFAGEVEAVDHRWNQHGLGGDNVHGSCRPLHDGPVSLMHWSGKGKPWDRLDAGRPCPLDHTWRLYDLYIPSDGSGAASPASGPALSASLFSW

SEQ ID NO: 4692 - protein, 353 aa, Hordeum vulgare
MRVAGAAVALLFFFLAGEAAALPRFAEAPQYRNGEGCPAPSAAAAGVCDPGLVHIAMTLDAHYLRGSMAAIYSLLRHASCPESLFFHFLAAAPGDGELRAALGASFPSLRFEIYPFRAEAVAGLISASVRAALEAPLNYARNHLADLLPPCVPRAIYLDSDVLAVDDVRRLWETRLPAAAVVAAPEYCHANFSRYFTPAFWSDPALGARVFAGRRRPPCYFNTGVMVIDLRRWRAGNYRRRIERWMEIQKEQRIYELGSLPPFLLVFAGEVEAVDLRWNQHGLGGDNVHGSCRPLHDGPVSLMHWSGKGKPWDRLDAGRPCPLDHTWKSYDLYVPGDGSSAASPASGPALSAW

SEQ ID NO: 4693 - protein, 372 aa, Zea mays
MGGAAGEAMWAAVVAATVVFLAVEVSGAASALPRFAEAPEYRNGEGCPAAAAGVCDPGLVHIAMTLDTHYLRGSMAAVYSLLKHASCPESIFFHFLAAEAGAVDGADPEPELLRRAVAASFPSLRFEIYPFRAEAVAGLISASVRAALEAPLNYARNHLADLLPRCVPRAIYLDSDVLAADDVRRLWETRLPAAAVVAAPEYCHANFSRYFTPAFWSDPVLGARVFAGRRRPPCYFNTGVMVIDLRRWRAGNYRQRIERWMEIQKQKRIYELGSLPPFLLVFAGEVEAVDHRWNQHGLGGNNVHGSCRPLHAGPVSLMHWSGKGKPWDRLDAGRPCPLDHTWKSYDLYIPGDSGGAASPASGPALSASVFSW

SEQ ID NO: 4694 - protein, 364 aa, Oryza sativa
MPARAAAAAAAVALLLAVCAQAAALPRFAEAPEYRNGEGCPAAATAAAGVCDAGLVHISMTLDAHYLRGSMAAVYSLLKHASCPESLFFHFLAEEEEVGGGGDLRRAVAASFPSLRFEIYAFRAEAVAGLISASVRAALESPLNYARNHLADLLPRCVPRAIYLDSDVLAVDDVRRLWETRLPAAAVVAAPEYCHANFSRYFTPAFWSDPGLGRRVFAGRRRPPCYFNTGVMVIDLRRWRAGNYRHRIERWMEIQKEKRIYELGSLPPFLLVFAGEVEAVDHRWNQHGLGGDNVRGSCRPLHDGPVSLMHWSGKGKPWDRLDAGNPCPLDHTWKSYDLYVAGDDGAAASSPASGPALSSTSTTW

SEQ ID NO: 4695 - protein, 356 aa, Brachypodium distachyon
MAGAVALLFLATAAAVLVSGGEAGAEALPRFAEAPEYRNGEGCPAAAAGVCDPGLVHIAMTLDAHYLRGSMAAIYSLLKHASCPESLFFHFMAAAPGDAELRRAVAASFPSLRFEIYPFRAEAVAGLISASVRAALEAPLNYARNHLADLLPPCVPRAIYLDSDVLAADDVRRLWETRLPAAAVVAAPEYCHANFSRYFTPAFWSDPELGARVFADRRRPPCYFNTGVMVIDLRRWRAGNYRRRIERWMEIQKDKRIYELGSLPPFLLVFAGEVEAVDLRWNQHGLGGDNVHGSCRPLHDGPVSLMHWSGKGKPWDRLDAGRPCPLDHTWKSYDLYIGGDGSSAATPASGPALSSW

SEQ ID NO: 4696 - protein, 366 aa, Hordeum vulgare
MRALALAAFLFLAASGVGALPRFAEAPEYRNGEGCQAAVAGAGVCDPGLVHIAMTLDAHYLRGSMAAIYSLLKHASCPESLFFHFLAADGAANGAAPGVGELRSALAASFPSLRFEIYPFRADAVTGLISASVRAALEAPLNYARNYLADLLPKCVPRAIYLDSDVLAVDDVRRLWETRLPAAAVVAAPEYCHANFSRYFTDAFWSDPDLGPRVFAGRRRAPCYFNTGVMVIDLRRWRSGNYRQRIEQWMELQKEKRIYELGSLPPFLLLFAGEVEAVDHRWNQHGLGGDNVLGSCRPLHKGPVSLMHWSGKGKPWDRLDAGRPCPLDHTWKSYDLYIGDGDASQASAPSWASLSSSALPAAVFSW

SEQ ID NO: 4697 - protein, 359 aa, Avena sativa
MMAGAAAAAALIIFLAATAAVSGAELPRFAEAPQYRNGEGCPAAAAGVCDPGLVHIAMTLDAHYLRGSMAAIYSLLKHASCPESLFFHFLAADAPPGDITGLRRAVAASFPSLRFEIYPFRAEAVAGLISASVRAALDAPLNYARNHLADLLPPCVPRAIYLDSDVLAADDVRRLWETRLPAAAVVAAPEYCHANFSRYFTPAFWSDPELGTRVFAGRRRPPCYFNTGVMVIDLRRWRAGNYRRRIERWMEIQKEKRIYELGSLPPFLLVFAGEVEAVDLRWNQHGLGGDNVHGSCRPLHDGPVSLMHWSGKGKPWDRLDAGRPCPLDHTWKSYDLYIPGDGSGAASPASGPALSASWL

SEQ ID NO: 4698 - protein, 345 aa, Secale cereale
GALPRFAEAPEYRNGEGCPAAVAGAGVCDPGLVHIAMTLDAHYLRGSMAAIYSLLKHASCPESLFFHFLAADGAAPGVDELRSALAASFPSLRFEIYPFRADAVTGLISASVRAALEAPLNYARNYLADLLPKCVPRAIYLDSDVLAVDDVRRLWETRLPAAAVVAAPEYCHANFSRYFTDAFWSDPDLGPRVFAGRRRAPCYFNTGVMVIDLRRWRSGNYRHRIEQWMELQKEKRIYELGSLPPFLLLFAGEVEAVDHRWNQHGLGGDNVLGSCRPLHKGPVSLMHWSGKGKPWDRLDAGRPCPLDHTWKSYDLYIGDGDASLASAPSWASLSSSALPAAVFSW

SEQ ID NO: 4699 - protein, 343 aa, Triticum aestivum
LPRFAEAPEYRNGEGCPAAVAGAGVCDPGLVHIAMTLDAHYLRGSMAAIYSLLKHASCPESLFFHFLAADGAAPGVAELRSALAASFPSLRFEIYPFRADAVTGLISASVRAALEAPLNYARNYLADLLPKCVPRAIYLDSDVLAVDDVRRLWETRLPAAAVVAAPEYCHANFSRYFTDAFWSDPDLGARVFAGRRRAPCYFNTGVMVIDLRRWRSGNYRHRVEQWMELQKEKRIYELGSLPPFLLLFAGEVEAVDHRWNQHGLGGDNILGSCRPLHKGPVSLMHWSGKGKPWDRLDAGRPCPLDHTWKSYDLYIGDGDASQASAPSWASLSSSALPAAVFSW

SEQ ID NO: 4700 - protein, 371 aa, Oryza sativa
MPARAAAAAAAVALLLAVCAQAAALPRFAEAPEYRNGEGCPAAATAAAGVCDAGLVHISMTLDAHYLRGSMAAVYSLLKHASCPESLFFHFLAEEEEVGGGGDLRRAVAASFPSLRFEIYAFRAEAVAGLISASVRAALESPLNYARNHLADLLPRCVPRAIYLDSDVLAVDDVRRLWETRLPAAAVVAAPEYCHANFSRYFTPAFWSDPGLGRRVFAGRRRPPCYFNTGVMVIDLRRWRAGNYRHRIERWMEIQKEKRIYELGSLPPFLLVFAGEVEAVDHRWNQHGLGGDNVRGSCRPLHDGPVSLMHWSGKGKPWDRLDAGNPCPLDHTWKSYDLYVAGDDGAAASSPASGPALSSTSTTWPALVFSW

SEQ ID NO: 4701 - protein, 352 aa, Setaria italica
MGGAAGEAMRAGVAVAAAVFLAFAFSGAAAALPRFAEAPEYRNGEGCPAAAAGVCDPGLVHIAMTLDAHYLRGSMAAVYSLLKHASCPESIFFHFLAAEAGAAGGEGPEPEPELLRRAVAASFPSLRFEIYPFRAEAVAGLISASVRAALEAPLNYARNHLADLLPRCVPRAIYLDSDVLAADDVRRLWETRLPAAAVVAAPEYCHANFSRYFTPAFWSDPDLGARVFAGRRRPPCYFNTGVMVIDLRRWRAGNYRQRIERWMEIQKEKRIYELGSLPPFLLVFAGEVEAVDHRWNQHGLGGDNVHGSCRPLHDGPVSLMHWSGKGKPWDRLDAGRPCPLDHTWRLYDLYIP

SEQ ID NO: 4702 - protein, 192 aa, Saccharum officinarum
MATILENIQKARFLPTRPLKDELPTFQGGFGGGGKEESHLMGLRKRLSSFSGKIQPISSASAEWAFRRSKSAPSLGAAFAAGGGSLRQWWQWGVGWLLSKKPGFAGDLEMNEEEVAALGRQGRGSWAHILYKMRSGVRRLVMSTHSLPTTHKQSSLPSSASAVHNNVQCKPAAAFAYAQRQSFHHTGHAMAH

SEQ ID NO: 4703 - protein, 191 aa, Zea mays
MATILENIQKARFLPTRPLKDELPTFQGGGKSKEESHLMGLRKRLSSFSGKIQPISSASAAEWAFRRSKSAPSLGAAFAAGGGSLRQWWQWGVGWLLSKKPGFAGDLEMNEEEVAALGRQSRGTWAHILFKMRSGVRRLVASAHSLPTTHKQQSLPSSSAAAAHSVQCKPAASFAYAQRQSFHHTGHAMAH

SEQ ID NO: 4704 - protein, 193 aa, Setaria italica
MATILENIQKTRFLPTRPLKDELPTFQGRLGGGGGGGKESHLMGLRKRLSSFSGKIQPISSASAEWAFRRSKSAPSLGAAFAAGGGSLRQWWQWGVGWLLTKKPGFAGDLEMNEEEVAALGRQSRGSWGHILYRVRAGVRRLVMSTHSLPTTQKQSSLPSSAVQQHNAQCKPAAALAYVQRQSFHHNGHAMAH

SEQ ID NO: 4705 - protein, 187 aa, Panicum virgatum
MATILESIQKTRFLPTRPLKDELPTFQGGLGGGKESHLMGLRKRLSSFSGKIQPISSASAEWAFRRSKSAPSLGAAFAAGGGSLRQWWKWGVGWLLSKKPGFAGDLEMNEEEVAALGRQSRGSWGHILYKMRAGVRRLVMSSHSLPTTQKQSLPSAAPQHSAHCKPAAAFAYAQRQSFHLNGHAMAH

SEQ ID NO: 4706 - protein, 192 aa, Panicum virgatum
MATILESIQKTRFLPTRPLKDELPTFQGGLGGGGGGGGKESHLMGLRKRLSSFSGKIQPISSASAEWAFRRSKSAPSLGAAFAAGGGSLRQWWAWGVGWLLSKKPGFAGDLEMNEKEVAALGRQSRGSWGHILYKMRAGVRRLVMSTHSLPNTQKQSLPSAAAQHSAHCKPAAAFAYAQRQSFHLNGHAMAH

SEQ ID NO: 4707 - protein, 197 aa, Pennisetum glaucum
MATILENIQKTRFLPKRPLKDELPTFQGGLGGGGGGGGGGGLESHLMGMRKRLSSFSGKIQPISSASAEWAFRRSKSAPSLGAAFAAGGGSLRQWWQWGVGWLLAKKPGFAGDLEMNEEEVAALGRQGRGSWGHILYKVRAGVRRLVTSTHSLPTTQKQSSLPSSAVQQRNAQCKPAAAFAYAQRQSFHHNGHAMAH

SEQ ID NO: 4708 - protein, 185 aa, Brachypodium distachyon
MATILENIQKARFLPTRPLKDDLPTFQGGGSKEESHLMGLRKRLSTFSGKIQPISSASAEWAFRRSRSAPSLAAFAGAAGGPLKRWWDWGVGWLLSKKLGFAGDLEMNEEEVAALGRQSKGTWAHILYKVRSGVRRLVVSSHSLPTTQHKHHSLPTSAAHKAQCKPPAPFAYTQRSFQYGQAMAH

SEQ ID NO: 4709 - protein, 391 aa, Setaria italica
MAPSRRVLMLCGDYMEDYEAAVPLYALAALGVAVDRIAPGKHPGDACLTAVHEFLGFELYTELPGHRFAVTADFAAAAANPSRYDALVVPGGRFAEHLSADEGAVALVAAFAEMRRPVVLTCHSQLLLAAAGGLAGGVRCTAFFGVRPVVELAGGTWVDPEPFSLCVADGHVLSAIGWPAHAEIIAKLLAAMGARADAGRGGQRVLVLCADYVDDYEANVPFRALAGVGCRVESACPTKRRGEPCVTAIYDAVKPGAVSEERRGHNFAVTADWADASADGFDCVVVPGGRAPELLVTHESAVALVREFADKGKVVASIGQGHLLLAAAGLLRGRRCASGVPMRVVSRLAGAEVVETEGAVADGKIVTAAGWPDLAPFVARLVDLLGITVSF

SEQ ID NO: 4710 - protein, 115 aa, Zea mays
MSDLLSYISKVMCIKARSEATQAGEDGGCPADECRVCLSKIRLGEATRRLPCRHVFHRDCVDRWLSSCKRTCPLCRVYVADGNKQPVAAKHTSREAQALADDLVIWFSTVLVPGF

SEQ ID NO: 4711 - protein, 116 aa, Saccharum officinarum
MSDLLSYISKVMCIKARSEEATQAGEDGGCPADECRVCLSKIRLGEATRRLPCRHVFHRDCVDRWLLSCKRTCPLCRVYVADGNKQPVAAKHTSREAQALADDLVIWFSTVLVPGF

SEQ ID NO: 4712 - protein, 115 aa, Setaria italica
MSDLISYISKMLCIKARSEATPAGGEDGGGCAAEECRVCLSRIRVGEATRRLPCRHVFHRDCVDRWLLSCKRTCPLCRVYVADENRHPVAVKHTGREALADDLVIWFSTVLVPGF

SEQ ID NO: 4713 - protein, 112 aa, Panicum virgatum
SDLLSNISKMLCIKARSEATQAGEDDGYPVDECRVCLSRIRVGEATRGLPCRHVFHRDCIDRWLVSCKRTCPLCRVFVADKNRHPVAAKHTSREALTDDLVIWFSTVLVPGF

SEQ ID NO: 4714 - protein, 113 aa, Panicum virgatum
MSDLLSYISKMLCIKARSEVTQSGEDGGCLVDECRVCLSRMRVGEATRRLPCRHLFHRDCVNRWLVSCKQTCPLCRVYVADENRHPVAAKHTGREALADDLVIWFSTVLVPGF

SEQ ID NO: 4715 - protein, 318 aa, Zea mays
MASSAFLNALVLRSPSPSLSSSSNRRSTGAFAFPNPPRFPCLRSARRLVLARAAAAPAPGDGPEDEWGPEPEGGSAVTGAAVAEAPEAREVAELKAQLKDALYGTERGLRASSESRAKVLELITQLETRNPTPAPTEALTLLNGKWILAYTSFSQLFPLLGFGNLPQLVKVEEISQTIDSENFTVQNCIKFSGPLATTSVATNAKFEIRSPKRVQIKFDEGIVGTPQLTDSIVLPEKFELFGQNIDLSPLKGIFSSIENAASSVAKTISEQPPLKIPIRTNNAESWLLTTYLDEELRISRGDGSSIFVLFKEGSTLLY

SEQ ID NO: 4716 - protein, 305 aa, Saccharum officinarum
MAGSAFLNALVLRAPSPSPSLSCSSKRRSAGAFAFPNPPRFPSLRSVRRVVLARAAAAAPGGDPEPEDDEWGPEPEGGSAATGTAVAEAPEAPEAREVAELKAQLKDALYGTERGLRASSESRAKVLELITQLETRNPTPAPTEALTLLDGKWILAYTSFSQLFPLLGFGNLPELVKVEEISQTIDSENFTVQNCIKFSGPLATTSVATNAKFEIRSPKRVQIKFDEGIVGTSQLTDSIVLPEKFELFGQNIDLSPLKGIFTSIENAASSVAKTISDQPPLKIPIRTNNAESWLLTTYLDEELTI

SEQ ID NO: 4717 - protein, 314 aa, Zea mays
MAGSALLNALVLRAPSPSLSSSSKVRSAGAFVFSNPPRFPSLRSERRVALPRAAAGGDPEDEWVPEPEGGSAVTGTAVAEAPEAGEVAELKAQLKDALYGTERGLRASSESRAKVLELITQLETRNPTPAPTEALTLLNGKWILAYTSFSQLFPLLEFGKLPALVKVEEISQTIDSKNFTVQNCIKFSGPLATTSVSTNAKFEIRSPKRVQIKFDEGIVGTPQLTDSVVLPEKFEVFGQNIDLSPLKGIFSSIENAASSVAKTISGQPPLKIPIRANNAESWLLTTYLDEEVRISRGEGGGIFVLFKEGSTLLN

SEQ ID NO: 4718 - protein, 318 aa, Setaria italica
MAGVASLNALALRAPSPSPAAPSPRRGTVAGALAFPTPPRFPLLRAARRVLARAVAAGGDSEDEWGPEPEGGSAVTGTAVAEASDPEASEVAELKAQLKEALYGTERGLRASSETRAEVVELITQLEARNPTPAPTEALTLLNGKWILAYTSFSQLFPLLGSGRLPELVKVEEISQTIDSETFTVQNCIKFSGPLATTSVSTNAKFEIRSPKRVQIKFDEGVIGTPQLTDSIVLPEKFELFGQNIDLSPLKGIFSSIENAASSVANTISGQPPLKIPIRTNNAESWLLTTYLDEELRISRGDGSSIFVLFKEGSSLLN

SEQ ID NO: 4719 - protein, 316 aa, Panicum virgatum
MAGVASLTLTLRASSPSPAAPYPRGGSDAALAFPTPARFRSLRAARRRVLTRAVAAGGGDPEDEWVPEPEGGSTVTGVAEAPAPEASEVARLKARLKEALDGAERGLRASSETRADVVELIAQLEARNPTPAPTEALALLDGKWILAYTSFSQLFPLLGSGRLPELVKVEEISQTIDSENFTVQNCIKFSGPLATTSVSTNAKFEVRSPKRVQIKFEEGVIGTPQLTDSIVLPEKFELFGQNIDLSPLKGIFSSIENAASSVAKTISGQPPLKIPIQTNNAESWLLTTYLDEELRISRGDGGSIFVLLKEGSTLLN

SEQ ID NO: 4720 - protein, 110 aa, Saccharum officinarum
MAPSKLAVVIALVASLLLLTNSNTKAAPGGYPPAPPLGPPPHQIVDPAKDCGGACDVRCGAQSRKNRCTRACLKCCSVCRCVPAGTAGNQQTCGKCYTDWTTHGNRTKCP

SEQ ID NO: 4721 - protein, 110 aa, Setaria italica
MAPGKLAAAVALVATLLLLSNSNIKAAPGGYPPAPPVGPPPHQIVDPAKDCGGACDVRCGAHSRKNRCTRACLKCCSVCRCVPAGTAGNQETCGKCYTDWTTHGNRTKCP

SEQ ID NO: 4722 - protein, 111 aa, Panicum virgatum
  misc_feature (37)..(37): Xaa can be any naturally occurring amino acid
MAPSKLAVAVALVATLLLLSNSNIKAAPGGGYPPAPXVGPPPHQIVDPAKDCGGACDVRCGAHSRKNRCTRACLTCCKACRCVPAGTAGNQETCGKCYTDWTTHGNRTKCP

SEQ ID NO: 4723 - protein, 112 aa, Panicum virgatum
MAPSKLAVAVAMVATLLLLSNSNIKAAPGGGGYPPAPPVGPPPHQIVDPAKDCGGACDVRCGEHSRKNRCTRACLTCCRTCRCVPAGTAGNQETCGKCYTGWTTHGNRTKCP

SEQ ID NO: 4724 - protein, 341 aa, Zea mays
MAIGVPSMELHRSSPLLSGGRGGNTCLQKKPFFVQAKRLVGMEKASTRPGTQESGQTKKRAPLVRGTVSPPLPVPGNIPRPPYVGTEYVPEIAKEIQMHDKEGIVHMRAACELAARVLDYAGTLVKPSVTTDEIDKAVHKMIIDAGAYPSPLGYGGFPKSVCTSVNECMCHGIPDSRELQDGDIINIDVTVYLNGYHGDTSKTFLCGEVDEASKRLVKVTEECLLRGISTCKHGTSFKKIGRRISEHAERNGFGVVECFVGHGVGRVFHSEPIIYHQRNNRPGQMIEGQTFTIEPIISMGSIECDMWDDGWTAVTTDGSLAAQFEHTILITRTGAEILTKC

SEQ ID NO: 4725 - protein, 339 aa, Setaria italica
MAIRVPSMELHRPAPLVSGGRGKTCLQKKPFLVQAKRLGGLEKASTRGAQESGQPKKRAPLIRGTVSPPLPVPGNIPRPPYVGTKDVPEIAKEIQMHDKEGIIHMRAACELAARVLEYAGTLVKPSVTTDEIDKAVHKMIIDAGAYPSPLGYGGFPKSVCTSVNECMCHGIPDSRALQDGDIINIDVTVYLNGYHGDTSKTFLCGEVDEASKRLVKVTEECLLRGISTCKHGTSFKKIGRRISEHAERHGLGVVECFVGHGVGRVFHSEPIIYHQRNNKPGQMVEGQTFTIEPILSMGSTDCDMWDDGWTAVTTDGSLAAQFEHTILITRTGAEILTKC

SEQ ID NO: 4726 - protein, 178 aa, Setaria italica
ELHRPAPLVSGGRGKTCLQKKPFLVQAKRLGGLEKASTRGAQESGQPKKRAPLIRGTVSPPLPVPGNIPRPPYVGTKDVPEIAKEIQMHDKEGIIHMRAACELAARVLEYAGTLVKPSVTTDEIDKAVHKMIIDAGAYPSPLGYGGFPKSVCTSVNECMCHGIPDSRALQCFTGWRHN

SEQ ID NO: 4727 - protein, 340 aa, Oryza sativa
MAVRVPSMELHRPPPSVSGVRGKSCLQKPFLVQAKRLEGLEKANPRSRGKQSLEQVKKRAPLIRGTVSPPLPVPGHITQPPYVGKKDASEIASEIQMHDKVSIIHMKAACELAARVLEYAGTLVKPSVTTDEIDKAVHKMIIDAGAYPSPLGYGGFPKSVCTSVNECICHGIPDSRELQDGDIINIDVTVYLNGYHGDTSKTFLCGEVDEASKRLVKVTEECMLRAISACKHGTSLKKIGRRISEHAERHGFGVVDRFVGHGVGRIFHSEPMIYHQRNNMPGQMVEGQTFTIEPALSMGSIDCDMWDDGWTAVTTDGSLAAQFEHTILITKTGAEILTKC

SEQ ID NO: 4728 - protein, 346 aa, Panicum virgatum
  misc_feature (330)..(331): Xaa can be any naturally occurring amino acid
  misc_feature (336)..(336): Xaa can be any naturally occurring amino acid
MELHCPAPLLSGGRGNLFSPAACLLSTILGRTCLKKKLFLVQAKRLGGLEKASTRSKESEQPKKRAALIRGTVSPPLPVPGSIPRPPYVGTKDVPEIAKEIQMHDKESIVHMRAACELAARVLEYAGTLVKPSVTTDEIDKAVHKMIIDAGAYPSPLGYGGFPKSVCTSVNECMCHGIPDSRELQDGDIINIDVTVYLNGYHGDTSKTFLCGEVDEANKRLVKVTEECLLRGISTCKHGTSFKKIGRRISEHAERHGFGVVECFVGHGVGRVFHSEPIIYHQRNNKPGQMVEGQTFPIEPILSMGSPVCDMWDDGWTAVTTDGSLAAQFXXTILIXRTGAEILTKC

SEQ ID NO: 4729 - protein, 342 aa, Avena sativa
MAVRVPSMELNRSPPLLSGGRGKTCLKKLFIVQAKRSGGLDKAATRSQGTQTSLKLKKRAPLTRGTVSPPLPVPWNITRPPYVGSNKMPEISSEMQMHDKETIVHMRAACELAARVLENAGKLVKPSVTTDEIDKAVHKMIIDAGAYPSPLGYGGFPKSVCTSVNECMCHGIPDSRELQDGDIINIDVTVYLNGFHGDTSKTFLCGEVDEDSKRLVKVAEECMLRGISACKHGVSFKKIGRRISEHAERHGFGVVEQFVGHGVGRAFHSQPIIYHQRNNMPGQMVEGQTFTIEPILTMGKDSIECDMWDDGWTALTTDGSLATQFEHTILITRTGAEILTKC

SEQ ID NO: 4730 - protein, 342 aa, Triticum aestivum
MAVRVPSMELNRSPPLLSGGRGKTCLQKPFIVQAKRSGGLEKANTRPRGPQASEKLKKREPLTRGTVSAPLPVPGHIPRPPYVGSNKMPEISSERQMQDKETIVHMKAACELAARVLENAGKLVKPSVTTDEIDKAVHKMIIDAGAYPSPLGYGGFPKSVCTSVNECMCHGIPDSRELKDGDIINIDVTVYLNGFHGDTSKTFFCGEVDEASKRLVKVTEECMLRGISACKHGVSFKKIGRRISEHAERHGFGVVEQFVGHGVGRVFHSQPIIYHQRNNMPGQMVEGQTFTIEPILTMGSSSIECDMWEDGWTAVTTDGSLAAQFEHTILITRTGAEILTKC

SEQ ID NO: 4731 - protein, 342 aa, Triticum aestivum
MAVRVPSMELNRSPPLLSGGRGKTCLQKPFIVQAKRSGGLEKANTRPRGPQASEKLKKREPLTRGTVSAPLPVPGHIPRPPYVGSNKMPEISSERQMQDKETIVHMKAACALAARVLENAGKLVKPSVTTDEIDKAVHKMIIDAGAYPSPLGYGGFPKSVCTSVNECMCHGIPDSRELKDGDIINIDVTVYLNGFHGDTSKTFFCGEVDEAAKRLVKVTEECMLRGISACKHGVSFKKIGRRISEHAERNGFGVVEQFVGHGVGRVFHSQPIIYHQRNNMPGQMVEGQTFTIEPILTMGGSSIECDMWEDGWTAVTTDGSLAAQFEHTILITRTGAEILTKC

SEQ ID NO: 4732 - protein, 342 aa, Triticum aestivum
MAVRVPSMELNRSPPLLSGGRGKTCLQKPFIVQAKRSGGLEKANTRPQGPQASEKLKKREPLTRGTVSAPLPVPGHIPRPPYVGSNKMPEISSERQMQDKDTIVHMKAACELAARVLENAGKLVKPSVTTDEIDKAVHKMIIDAGAYPSPLGYGGFPKSVCTSVNECMCHGIPDSRELKDGDIINIDVTVYLNGFHGDTSKTFFCGEVDEASKRLVKVTEECMLRGIAACKHGVSFKKIGRRISEHAEKHGFGVVEQFVGHGVGRVFHSQPIIYHQRNNMPGQMVEGQTFTIEPILTMGSSSIECDMWEDGWTAVTTDGSLAAQFEHTILITRTGAEILTKC

SEQ ID NO: 4733 - protein, 333 aa, Oryza sativa
MELHRPPPSVSGVRGKSCLQKPFLVQAKRLEGLEKANPRSRGKQSLEQVKKRAPLIRGTVSPPLPVPGHITQPPYVGKKDASEIASEIQMHDKVSIIHMKAACELAARVLEYAGTLVKPSVTTDEIDKAVHKMIIDAGAYPSPLGYGGFPKSVCTSVNECICHGIPDSRELQDGDIINIDVTVYLNGYHGDTSKTFLCGEVDEASKRLVKVTEECMLRAISACKHGTSLKKIGRRISEHAERHGFGVVDRFVGHGVGRIFHSEPMIYHQRNNMPGQMVEGQTFTIEPALSMGSIDCDMWDDGWTAVTTDGSLAAQFEHTILITKTGAEILTKC

SEQ ID NO: 4734 - protein, 345 aa, Brachypodium distachyon
MAVGVPSMELNRSPPLLSGGRATLQGKTCLQKTFLVQAKRSGGLDKANTRSQGTRTSELKKRAPLTRGTVSAPLPVPGHIPRPPYVGTNNMPEISSEIQMHDKETIVHMKAACELAARVLENAGKLVKPSVTTDEIDKAVHKMIIDAGAYPSPLGYGGFPKSVCTSVNECMCHGIPDSRELKNGDIINIDVTVYLNGYHGDTSRTYFCGEVDEASKRLVKVTEECMLRGISACKHGASYKKIGRRISEHAERHGFGVVEQFVGHGVGRVFHSQPIIYHQRNNMPGQMVEGQTFTIEPILSMGSNSIECDMWEDGWTAVTTDGSLAAQFEHTILITRTGAEILTKC

SEQ ID NO: 4735 - protein, 335 aa, Avena sativa
MELNRSPPLLSGGRGKTCLKKLFIVQAKRSGGLDKAATRSQGTQTSLKLKKRAPLTRGTVSPPLPVPWNITRPPYVGSNKMPEISSEMQMHDKETIVHMRAACELAARVLENAGKLVKPSVTTDEIDKAVHKMIIDAGAYPSPLGYGGFPKSVCTSVNECMCHGIPDSRELQDGDIINIDVTVYLNGFHGDTSKTFLCGEVDEDSKRLVKVAEECMLRGISACKHGVSFKKIGRRISEHAERHGFGVVEQFVGHGVGRAFHSQPIIYHQRNNMPGQMVEGQTFTIEPILTMGKDSIECDMWDDGWTALTTDGSLATQFEHTILITRTGAEILTKC

SEQ ID NO: 4736 - protein, 336 aa, Hordeum vulgare
MAVRVQSMELNRSPTLLSGGRGKTCPFIVQVKRSGGLEKANTRSQASEKLKKREPLTRGIVSAPLPVPGHIPRPPYVGSNKMPEISSERQMQDKESIVHMKAACELAARVLENAGKLVKPSVTTDEIDKAVHKMIIDAGAYPSPLGYGGFPKSVCTSVNECMCHGIPDSRELKDGDIINIDVTVYLNGFHGDTSKTFFCGEVDEATKRLVKVTEECMLRGISACKHGVSFKKIGRRISEHAERHGFGVVEQFVGHGVGRVFHSQPIIYHQRNNMPGQMVEGQTFTIEPILTMGRSSIECDMWEDGWTAVTTDGSLAAQFEHTILITRTGAEILTKC

SEQ ID NO: 4737 - protein, 336 aa, Hordeum vulgare
MAVRVQSMELNRSPTLLSGGRGKTCPFIIQAKRSGGLEKANTRSQASEKLKKREPLTRGIVSAPLPVPGHIPRPPYVGSNKMPEISSERQMQDKESIVHMKASCELAARVLENAGKLVKPSVTTDEIDKAVHKMIIDAGAYPSPLGYGGFPKSVCTSVNECMCHGIPDSRELKDGDIINIDVTVYLNGFHGDTSKTFFCGEVDEATKRLVKVTEECMLRGISACKHGVSFKKIGRRISEHAERHGFGVVEQFVGHGVGRVFHSQPIIYHQRNNMPGQMVEGQTFTIEPILTMGRSSIECDMWEDGWTAVTTDGSLAAQFEHTILITRTGAEILTKC

SEQ ID NO: 4738 - protein, 338 aa, Brachypodium distachyon
MELNRSPPLLSGGRATLQGKTCLQKTFLVQAKRSGGLDKANTRSQGTRTSELKKRAPLTRGTVSAPLPVPGHIPRPPYVGTNNMPEISSEIQMHDKETIVHMKAACELAARVLENAGKLVKPSVTTDEIDKAVHKMIIDAGAYPSPLGYGGFPKSVCTSVNECMCHGIPDSRELKNGDIINIDVTVYLNGYHGDTSRTYFCGEVDEASKRLVKVTEECMLRGISACKHGASYKKIGRRISEHAERHGFGVVEQFVGHGVGRVFHSQPIIYHQRNNMPGQMVEGQTFTIEPILSMGSNSIECDMWEDGWTAVTTDGSLAAQFEHTILITRTGAEILTKC

SEQ ID NO: 4739 - protein, 138 aa, Saccharum officinarum
MDKTANVVLDIEGLPQPPDKCCSGSPKMIRALSRKGSNRMERRGGDEQEQEDFAKKLIIKVVPSQLEQPLGQNKALVAPHCTPCTPVLIDSGEGRSKRFSRFTSINPRKILLLFATLSSVGTTILIYFTLAINSKAEA

SEQ ID NO: 4740 - protein, 138 aa, Setaria italica
MDKTASVVLDIEGLPQPPDKCCSGSPKMIRALSRKGSNRMERRGGEEQEQEDLAKKLIIKVVPSQLDQPLVQNKALVAPHYTPCTPVLIDSGEGRSKRFNRFTSINPRKILLFFATLSSMGTTILIYFTLGINSKAEA

SEQ ID NO: 4741 - protein, 98 aa, Setaria italica
MDKTASVVLDIEGLPQPPDKCCSGSPKMIRALSRKGSNRMERRGGEEQEQEDLAKKLIIKVVPSQLDQPLVQNKALVAPHYTPCTPVLIDSGEKEQKI

SEQ ID NO: 4742 - protein, 138 aa, Pennisetum glaucum
MDKTASVVLDIEGLPQPPDKCCSGSPKMTRALSRKGSNRMERRGGDEQEQEDLLKKLIIKVAPSQLDQPLVQNKSLVAPHSTPCTPVLIDCGEGRCKRFNRFTSINPRKILLLFATLSSVGTTILIYFTLGINSKAEA

SEQ ID NO: 4743 - protein, 140 aa, Zea mays
MDRTANNAVLDIESLPQPPDKCCSGSPKMIRALSRKGSNRMERRGGGGGEQEQEDLAKKLVIKVVPSQLEQQPLGQNKALVAPHCTPVLVDSGEGRSKRFISRFTSINPRKILLLFATLSSVGTTILIYFTLAINSKAEA

SEQ ID NO: 4744 - protein, 138 aa, Panicum virgatum
  misc_feature (17)..(17): Xaa can be any naturally occurring amino acid
MDKTASVVLDIEGLPQXPDKCCSGSPKMTRALSRKGSNRMERRGGNEQEQEDMAKKLIIKVVPSQLEQPLVQNKPLVAPHCTPCTPILIDSGEGRNKRFNRFTAINPRKILLFFATLSSLGTTILIYFTLGINSKAEA

SEQ ID NO: 4745 - protein, 349 aa, Zea mays
MPAAMPSPPGRLLASIPLRCHAPTQQPSTTAARGLLLRGACSPVVKRVPDGGGWLLWHQSGPRVALSTSMDGLRWSAPVSPDPLLPSEDWWTFDTACVRPSDVLLVSSPAASSRRFPSSAVYWLYYMGSTDERFGSPFPDADVPALPGLAISQDGRHWARIEGDHHTGALFSVAEEGEKSRGWEARCIVAPKVVMHADGDLRMYYHSFDEMSQRHAIGLARSRDGIRWKKTGKVLEGGRAGCFDECGVQHGHVVRDRAARQYVMVFEGVDADGRVSIGMAVSEDGLKEWRRSSEMPVLCPSYDDEGWDAAGVGSPYLVQMDGAYDWRLYYMGVGRDGEASIGMAYSEGQ

SEQ ID NO: 4746 - protein, 426 aa, Setaria italica
EEEVIAGLTSDSLDLQFLFSHIFLQNTKIKKFPRCAMRRAPRPPNPAHGTTTLTISTLNPPAMLPAALLPSPAGRLLAPAPLRCHSPTQQSSTAAARGLILRGAGSPVVKRVPDGGGWLLWHQSGARVALATSPDGLRWSAPVSPDPLLPSEDWWAFDTAAARPSDVLLISGPAASSRRFPSSAVYWLYYTGSTDGRFGSAFPEADVPALPGLAISQDGRNWARIEGDHHTGALLGVGEEGEEPRGWEARCIAAPKVVMHADGDLRMYYHSFDEMSRRHAIGLARSRDGIRWTKIGKVLEGGRAGSFDECGVRHGHVVRDRAAGRYVMVYDGVDADGKVSIGMAVSEDGLKGWRRSSEMPVLCPSEEGEGWDGAGVGSPYLVQMDGAYDWRLYYMGVGRNGEASIGMAYSEGQALQKFEKCDAVLM

SEQ ID NO: 4747 - protein, 364 aa, Setaria italica
DLNSQPACHAPRRSPPLAGGPLSAATLPPSNPPPPRPAASSSAARAPLSSSASRTAAGGSSGTSPARASRSPPPRTGSAGAPPCPPTRCYPPRTGGRSTPPPPAPPTSSSSPAPPRPRAASRPPPCTGSTTRAPPTGGSAPRSPKRTSPRCRLAISQDGRNWARIEGDHHTGALLGVGEEGEEPRGWEARCIAAPKVVMHADGDLRMYYHSFDEMSRRHAIGLARSRDGIRWTKIGKVLEGGRAGSFDECGVRHGHVVRDRAAGRYVMVYDGVDADGKVSIGMAVSEDGLKGWRRSSEVLCPSEEGEGWDGAGVGSPYLVQMDGAYDWRLYYMGVGRNGEASIGMAYSEGQALQKFEKCDAVLM

SEQ ID NO: 4748 - protein, 216 aa, Zea mays
MAASLLVLAVAFLVGSGSGGIDGGAAAPVEVEGTEVAYGSVIKLMHEKTKHRLHSHDVPYGSGSGQQSVTGFPEGDDSNSYWIIRPTPDSSSKQGDAIETGGIIRLQHMRTRRWLHSHLHASPLSGNLEVSCFGGDELSDSGDHWRLEIEGSGKVWKRDQKVRLRHVDTGGYLHSHNKKYNRLGGGQQEVCGVREKRAENIWLTAEGVYLPVNGSK

SEQ ID NO: 4749 - protein, 216 aa, Zea mays
MAASLLVLAVAFLVGAGHGGIDGGAAAHMEVEGSEVTYGSVIKLLHEKTKHRLHSHDVPYGSGSGQQSVTGFPEGDDSNSYWIIKPTPDSSSKQGDSIQTGGIIKLQHMKTRRWLHSHLHASPLSGNLEVSCFGGDELSDTGDYWRLEIEGSGKVWKRDQKVRLRHVDTGGYLHSHSKKYNRLGGGQQEVCGVREKRAENIWLAAEGVYLPVNGSK

SEQ ID NO: 4750 - protein, 216 aa, Setaria italica
MAASLLALAVALLVSAGFSGVDRGTAAPVESEGGEVTYGSVIKLMHEKTKHRLHSHDVPYGSGSGQQSVTGFPEGDDSNSYWIIRPTPDSSSKQGDAIETGSIVKLQHMRTRRWLHSHLHASPLSGNLEVSCYGGDELSDTGDYWRLEIEGSGKVWKRDQKIRLRHVDTGGYLHSHNKKYNRLGGGQQEVCGVREKRAENIWLAAEGVYLPVNGSK

SEQ ID NO: 4751 - protein, 216 aa, Pennisetum glaucum
MAASLLALAVALLVSAGFGGVDRGAAAPLDTEGGEVTYGSVIKLMHEKTKHRLHSHDVPYGSGSGQQSVTGFPEGDDSNSYWIIRPTPDSSSKQGDAIETGSIVKLQHMKTRRWLHSHLHASPLSGNLEVSCFGGDELSDTGDYWRLEIEGSGKVWKRDQKIRLKHIDTGGYLHSHNKKYNRLGGGQQEVCGVREKRAENIWLAAEGVYLPVKGSK

SEQ ID NO: 4752 - protein, 217 aa, Oryza sativa
MAASVLALAVAFLLGASGYGVDRGAAAASPAAEGVEVAYGSTIKLMHEKTKHRLHSHDVPYGSGSGQQSVTGFPEVDDSNSYWIVRPSPDSSAKQGDAIETGSIIRLQHMRTRKWLHSHLHASPLSGNLEVSCFGGDGQSDTGDYWRLEIEGGGKLWKQDQKVRLRHVDTGGYLHSHNKKYNRLGGGQQEVCGVREKRAENIWLATEGVYLPVNKSK

SEQ ID NO: 4753 - protein, 188 aa, Panicum virgatum
VETEGGEVTYGSVIKLMHEKTKHRLHSHDVPYGSGSGQQSVTGFPEGDDSNSYWIIRPTPDSSSKQGDSIETGSIIKLQHMRTRRWLHSHLHASPLSGNLEVSCFGGDELSDTGDYWRLEIEGSGKVWKRDQKVRLRHVDTGGYLHSHNKKYNRLGGGQQEVCGVREKRAENIWLAAEGVYLPVNGSK

SEQ ID NO: 4754 - protein, 216 aa, Triticum aestivum
MAASVLALAVALLLGASSRVDHGAAAAPVSEEGLQVTYGSTVKLMHEKTKVRLHSHDVAYGSGSGQQSVTGFPEIDDSNSYWIVRPTLDSSAKQGDAVETGSIIRLQHMRTRRWLHSHLHASPLSGNLEVSCFGGDGQSDTGDYWRLEIEGKDKVWKRDQKVRLRHVDTGGYLHSHNKKYNRLGGGQQEVCGVRDKRAENIWSTAEGVYLPVDESK

SEQ ID NO: 4755 - protein, 216 aa, Hordeum vulgare
MAASVLALAVALLLGASSRVDHGAAAAPVSEEGLQVTYGSTVKLMHEKTKVRLHSHDVAYGSGSGQQSVTGFPEIDDSNSYWIVRPTLDSSAKQGEAIETGSIIRLQHMRTRRWLHSHLHASPLSGNLEVSCFGGDGQSDTGDYWRLEIEGKDKVWKRDQKVRLRHVDTGGYLHSHNKKYNRLGGGQQEVCGVRDKRAENIWSTAEGVYLPVDERK

SEQ ID NO: 4756 - protein, 216 aa, Avena sativa
MAASVLALAVVLLIGASSQVDNGASAAPVTEEGLEVTYGSTVKLMHDKTKVRLHSHDVAYGSGSGQQSVTGFPQTDDSNSYWIVRPTLDSSAKQGDAIETGSIIRLQHMRTWRWLHSHLHASPLSGNLEVSCFGGDEQSDTGDYWRLEIEGKDKIWKRDQKVRLRHVDTGGYLHSHNKKYNRLGGGQQEVCGVRDKRAENIWSTAEGVYLPVSGSK

SEQ ID NO: 4757 - protein, 216 aa, Secale cereale
MAASVLALAVALLLGASSRVDHGAAAAPVSEEGLQVTYGSTVKLMHEKTKVRLHSHDVAYGSGSGQQSVTGFPEIDDSNSYWVVRPTLDSSAKQGDAIETGSIIRLQHMRTRRWLHSHLHASPLSGNLEVSCFGGDGQSDTGDYWRLEIEGKDKVWKRDQKVRLRHVDTGGYLHSHNKKYNRLGGGQQEVCGVRDKRAENIWSTAEGIYLPVDESK

SEQ ID NO: 4758 - protein, 216 aa, Brachypodium distachyon
MAASVLALAVAILLGASSRVDMGDAASPVAEEGLEVTYGSTVKLMHEKTKVRLHSHDVAYGSGSGQQSVTGFPEIDDSNSYWIVKPSLDSSAKQGDAIETGTIVRLQHMRTRRWLHSHLHASPLSGNLEVSCFGGDGQSDTGDYWRLEIEGSGKVWKRDQKVRLRHVDTGGYLHSHNKKYNRLGGGQQEVCGVRDKRAENIWSTAEGVYLPVNVSK

SEQ ID NO: 4759 - protein, 437 aa, Hordeum vulgare
MKVEVVESALVAPSEETPRRELWLSNLDLAVPKTHTPLVYYYPAPAPATAAPDADPAGFFSPERLRAALARALVLFYPLAGRLGREGEGGRLQIDCSGEGALFVVARAPDVAGDELFGSGYEPSPEIRRMFVPFAPSGDPPCLMAMFQVTFLKCGGVVLGTGIHHVTMDGMGAFHFIQTWTGLARGLALSEACPSPPFHDRTLLRARSPPRPEFDHPVYSPEYLNGAPRPFVTRVYSVSPKLLADLKSRCAPGASTYGAVTAHLWRCMCVARGLAAGSDTRLRVPANIRHRLRPPLPRQFFGNAIVRDLVTVKVGDVLAQPLGYVADTIRKAVEHVDDAYTRSVMDYLEVESEKGSQAARGQLMPESDLWVVSWLGMPMYDADFGWGAPRFVAPAQMFGSGTAYVTQRGADRDDGIAVLFALEPQYLHCFQDVFYGE

SEQ ID NO: 4760 - protein, 431 aa, Secale cereale
MKVEVVESTLVAPSEETPRRALWLSNLDLAVPKTHTPLVYYYPAPAPDSDSADFFSPDRLRAALAKALVLFYPLAGRLGRDEGGRLQIDCNGEGALFVVARAPDIAGEDLFGSGYEPSPEIRRMFVPFAPSGDPPCHMSMFQVTFLKCGGVVLGTGIHHVTMDGMGAFHFIQTWTGLARGLALSDACPSPPFHDRTLLRARSPPHPEFDHPVYSPAYLNGAPRPFVTRVYSVSPKLLADLKSRCAPGASTYGAVTAHLWRCMCVARGLAPGSDTRLRVPANIRHRLCPQLPRQFFGNAIVRDLVTVKVGDVLSQPLGYVADTIRKAVDHVDDAYTRSVIDYLEVESEKGSQAARGQLMPESDLWVVSWLGMPMYDADFGWGAPRFVAPAQMFGSGTAYVTQRGADRDDGIAVLFALEPQYLQCFQDVFYGE

SEQ ID NO: 4761 - protein, 178 aa, Saccharum officinarum
MAPSKPSSSAAALLLLAVAMLAAASVTPALADVTHANCAKNKKVTVQNLCTHDVTLTLEPLANSPPLFTGAYTLHPHSHAEFPVCWWTGRLHAGADAATVEFHVGVDGGSFYLAPNAQPGQRVPVSVTPHAASAASPLQGRCPAVGCAVEGKCSVHQVPSGDCRNVQEMKIIYCNPHV

SEQ ID NO: 4762 - protein, 180 aa, Saccharum officinarum
MAASKPSSSAAALLLLLAVTVLLAASSTTPVLADVTHANCAKNKKVTVQNLCTHDVTLTLEPLANSPPLFTGAYTLHPHSHAEFPVCWWTGRLHAGADAATVEFHVGVDGGSFYLAPNAQPGQRVPVSVTPHAASAASPLQGRCPAVGCAVEGKCSVHQVPSGDCRNVQEMKIIYCNPHV

SEQ ID NO: 4763 - protein, 167 aa, Zea mays
MASPKPSSAALLLLAAAAVLALARADLTHDNCVKNKKVTVQNLCSHDVTLTLEPLANSPPLFAGTYTLHPRSHAEFPVCWWTGRLRAPDAAQVEFHVGVDGGSFYLAPNAQPGQRVPVSVTPHGSPLQGRCPAVGCAIQGRCSVHQVPSGDCRNVQEMKIIYCNPHV

SEQ ID NO: 4764 - protein, 787 aa, Zea mays
MVARMMRWPRPPPARNIRVRLVVRRAEGLPPPPAPLSPDGSPGPEAEAKAFVEVSWKGPKMSPLSSLRRAQRPPRNQTRKEALPAVAAAALEDGAAAAPALAVSAVAWDEEFERDAALTATSHREPAAFHPWDVTFSVVSESNKISKSKLVLGTASLNLADYASAAEEEIEIILPLSVPSSATDLVPSLHLTLSLAEVRTSQQSPGASQRSVIAPLSPSSGDSLASGKDEVSVIKVGLRNLKMLRDLVSTRRFKKTNQDFDGSEKYYVHSDGAEFSCDTDSLDDDLDDREHDDEFGGSAVRKSFSYGSLQTMNVGALLYAPRIDGDDEGWVHYSHRNSDVGYHVEQVPPPTAEEHASIPLRRKRSILPARWRKVKLPKAKGEPLLKPYGEEGGDDIDYDRRLLTPSDGSVSEVHILLTSQGSNGSNSMVSVFGDDDFVVGNWESKEVFSRDGHLKLSTQVFFASIDQRSERAAGESACTALVAVVADWFQTNQDLMPIRSQFDNLIREGSLEWRRLCENETYRERFPDKHFDLETVLHAKIRPLTVAHSKSFIGFFHPQGTEDVTGFDFLDGAMSFDNIWDEISRAAECSSGKPALYIVSWNDHFFVLKVDANAIYIIDTLGERLSEGCNQAYILKFDDTTTIHKTPAEKKEPSPDHRGRRKDSSETCSTEQGSGSDTEECEPVLKGKDACKEYIKSFLAAIPIRELQADIKKGLMASTPLHHRLQIEFHYTEPRPAEIAAPSPLPPFEAPFEFCWPEPPSPPAATESTVTHPPAMEAGITQAVAVV

SEQ ID NO: 4765 - protein, 778 aa, Setaria italica
MVARMMRWPRPPPARDFRVRLVVRRAEGLPPPPAPLSPEGSPEAEAKVFVEVCWKGPKMSPLSSLRRAQRPPRNQTRKEALPAAGTAATPADVEDGATAPAPRMVAVAWEEEFERDAALTAMSHREATAFQPWDISFSVVSESNKMSKNKLVLGTASLNLADYASAAEEEIEIILPLSATSGSTDLSPSLHLTLSLAELKVSPQSPGASQRSVVVAPLSPSSGDSVPSGKDEGSVIKVGLRNLKILRDLVSTRRFKKTNCDGTEEKYYVHSDGAEFSCDTDSLDDDLDDREQDDDLEGSTVRKSFSYGSLQTMNVGALLYAPRIDGDDEGWIHYSHRNSDASYHVEQVPSSTAEEHASIPVRRKRSILPVRWRKTKLPKAKGEPLLKPYGEEGGDDIDYDRRLLTPSDGSVSEGSNGSTNSMVSVFGDDDFVVGNWELKEVFSRDGHLKLSTQVFFASIDQRSERAAGESACTALVAVIADWFQANQDLMPIRSQFDNLIREGSLEWRKLCENETYRERFPDKHFDLETVLHAKIRPLTVAPSKSFIGFFHPEGTEDVSGFDFLDGAMSFDNIWDEISRAAECSTGKSTLYIVSWNDHFFVLKVDADAYYIIDTLGERLSEGCNQAYILKFDDNTMIHKVPAEKKEANPDSSGRLKDSSESSSSTEQDSGTDTEECELVLKGKDACKEYIKSFLAAIPIRELQADIKKGLMASTPLHHRLQIEFHYTESCPAEITMPAQFPTFEFCWPEPPSPTPAMEAVVTHPPPMEVAVTRAVAVV

SEQ ID NO: 4766 - protein, 120 aa, Saccharum officinarum
MAMAPCAPVSVSFPARPAAGSPSSARPRRAAGAVRAAAEGGRWWAPLLGWSGKADYIEAPALQAVVVPQDDDAGAAARRQFVGGLTEEKARQLRARMAQTESFHDAMYHSAIASRLARSA

SEQ ID NO: 4767 - protein, 187 aa, Saccharum officinarum
MEKEAAAQAQAQEEEQWQGAVEATLPSTPASAAWPHIASFCALHRYLPSIDVCELAEGEDGRPGCVRYVSSLAPGTTAGEVGIWAREKLLEIDDDARRLAYAVVGSSMGFGRYVATMSIVAADQEGENDAGCRLVWAFECEPVQGWTRDGLLGYLDGGVKAIAARIEEAHAADAANAGGDNVVVVAA

SEQ ID NO: 4768 - protein, 453 aa, Pennisetum glaucum
MSFRSIVRDVRDGFGSLSRRSFEVTIAGLSGLTGHHRGKSQSTVHELRDTDLMIQESRWANLPPELLQDVIRRLEASESTWPNRKNVVSCAAVCRAWREMCREIVLSPEFCGKLTFPVSLKQPGHRDGMIQCFIKRDKSKSTYHLYLCLSTAVLTENGKFLLSAKRNRKTTCTEYIISMDADNISRSSNTYIGKLRSNFLGTKFMIYDTQPPYNGAVVPHAGRTSRRFNSKKVSPKVPTGSYNIAQVTYELNVLGTRGPRRMHCVMHSIPASAVEPGGIVPGQPEQILPRALEESFRSTTSFSKSSIMDRSMDFSSSHDFGSVRDFSSARFSDIAGGAMVDGEEGQNKERPLVLRNKAPRWHEQLQCWCLNFRGRVTIASVKNFQLIAASSQPPAAAGAPTVSQPAPSDQDKVILQFGKVAKDMFTMDYRYPLSAFQAFAICLSSFDTKLACE

SEQ ID NO: 4769 - protein, 452 aa, Setaria italica
MSFRSIVRDVRDGFGSLSRRSFEVTIAGLSGLTGHHRGKSQSTVHELRDTDLIIQESRWANLPPELLRDVIRRLEASESTWPNRKNVVSCAAVCRTWREMCREIVLSPEFCGKLTFPVSLKQPGHRDGMIQCFIKRDKSKSTYHLYLCLSTAVLTENGKFLLSAKRNRKTTCTEYVISMDADNISRSSSTYIGKLRSNFLGTKFMIYDTQPPYNGAVVPHAGRTSRRFNSKKVSPKVPTGSYNIAQVTYELNVLGTRGPRRMHCVMHSIPASAVEPGGIVPGQPEQILPRALEESFRSTTSFSKSSIMDRSMDFSSSRDFGSVRDFSSARFSDIARGAMVGDEEEQNKERPLVLRNKAPRWHEQLQCWCLNFRGRVTIASVKNFQLIATSSQPPATGAPTVSQPAPSDQDKVILQFGKVAKDMFTVDYRYPLSAFQAFAICLSSFDTKLACE

SEQ ID NO: 4770 - protein, 452 aa, Setaria italica
MSFRSIVRDVRDGFGSLSRRSFEVTIAGLSGLTGHHRGKSQSTVHELRDTDLIIQESRWANLPPELLQDVIRRLEASESTWPNRKNVVSCAAVCRTWREMCREIVLSPEFCGKLTFPVSLKQPGHRDGMIQCFIKRDKSKSTYHLYLCLSTAVLTENGKFLLSAKRNRKTTCTEYVISMDADNISRSSSTYIGKLRSNFLGTKFMIYDTQPPYNGAVVPHAGRTSRRFNSKKVSPKVPTGSYNIAQVTYELNVLGTRGPRRMHCVMHSIPASAVEPGGIVPGQPEQILPRALEESFRSTTSFSKSSIMDRSMDFSSSRDFGSVRDFSSARFSDIARGAMVGDEEGQNKERPLVLRNKAPRWHEQLQCWCLNFRGRVTIASVKNFQLIATSSQPPATGAPTVSQPAPSDQDKVILQFGKVAKDMFTVDYRYPLSAFQAFAICLSSFDTKLACE

SEQ ID NO: 4771 - protein, 445 aa, Oryza sativa
MSFRSIVRDVRDSFGSLSRRSFEVTLAGLSGLTGHHRGKSQSTVHELCDADLIIQESRWASLPPELLRDVIRRLEASESTWPSRKDVVSCAAVCKAWREMCKEIVLSPEFCGKLTFPLSLKQPGPRDGMIQCFIKRDKSKSTYHLYLCLSTAVLADSGKFLLSAKRHRKTTCTEYVISMDADNISRSSSTYIGKLRSNFLGTKFIIYDTQPSYNGAVIPPVGRSSRRFNSKKVSPKMPSGSYNIAQVTYELNVLGTRGPRRMHCVMHSIPASSVEPGGIVPGQPEQIVPRAFEESFRSTTSFSKSSIMDRSMDFSSSRDFSSARFSDIAGGTINGDEEGQNKERPLVLRNKAPRWHEQLQCWCLNFRGRVTIASVKNFQLIAAPAQPPAGAPTPSQPAPPEQDKIILQFGKVAKDMFTMDYRYPLSAFQAFAICLSSFDTKLACE

SEQ ID NO: 4772 - protein, 445 aa, Brachypodium distachyon
MSFRSIVRDVRDGFGSLSRRSFEVTISGLSGLTGHHRGKSQSTVHELRDADLIVQESRWACLPPELLRDVIRRLEASESTWPSRKHVVSCAAVCRAWREMCREIVISPEFCGKLTFPVSLKQPGPRDGMIQCFIKRDKSKSTYHLYLCLSTAVLVENGKFLLSAKRNRKTTCTEYVISMDADNISRSSSTYIGKLRSNFLGTKFIVYDTQPPHDGAVVPPVGRSSRRFNSKKVSPKVPSGSYNIAQVTYELNVLGTRGPRRMNCIMQSIPASSVEPGGIVPGQPEQILPRALEESFRSITSFSKSSIMDRSMDFSSSRDFSSTHFSDIAGGTINSDEEEQNKERPLVLRNKVPRWHEQLQCWCLNFRGRVTIASVKNFQLIAAPLQPPAGAPTPSQPAPPEQDKIILQFGKVSKDMFTMDYRYPLSAFQAFAICLSSFDTKLACE

SEQ ID NO: 4773 - protein, 452 aa, Hordeum vulgare
MSFRSIVRDVRDGIGSLSRRSFEVTISGLSGLTGHHRGKHQSTVHELRDADLIVQESRWASLPPELLRDVVRRLEASESTWPSRKHVVSCAAVCKAWREMCREIVTSPEFCGKLTFPVSLKQPGPRDGMIQCFIKRDKSKSTYHLYLCLSNAVLAENGKFLLSAKRNRKTTCTEYVISMDAENISRSSSTYIGKLRSNFLGTKFVVYDTQPPYNGAIVPSVGRSSRRFNSKKVSPKVPSGSYNIAQVSYELNVLGTRGPRRMNCIMHSIPASSVEPGGTVPGQPDQIMARALEDSFRSMSSFSKSSIMDRSTDFSSSRYFSSSRFLSDIAGGAISRDEDGENKERPLVLRNKVPRWHEQLQCWCLNFRGRVTIASVKNFQLIAAPSQPPPAPAGAPTPTPSQPAPAPEQDKIILQFGKVSKDMFTMDYRYPLSAFQAFAMCLSSFDTKLACE

SEQ ID NO: 4774 - protein, 454 aa, Triticum aestivum
MSFRSIVRDVRDGFGSLSRRSFEVTISGLSGLTGHHRGKCQSTVHELRDADLIVQESRWASLPPELLSDVIRRLEASESTWPSRKHVVSCAAVCKAWRDMCREIVTSPEFCGKLTFPVSLKQPGPRDGMIQCFIKRDKSKSTYHLYLCLTNAVLVENGKFLLSAKRIRRTTCTEYVISMDAENISRSSSTYIGKLRSNFLGTKFIVYDTQPPYNGALVPPVGRSSRRFNSKKVSPKVPSGSYNIAQVSYELNVLGTRGPRRMNCIMHSIPASSVEPGGIVPGQPDQIMPRALEDSFRSMSSFSKSSIMDRSTDFSSSRYFSSSRFLSDIAGGAISRDEDGENKERPLVLRNKVPRWHEQLQCWCLNFRGRVTIASVKNFQLIAAPSQPAPPPAGAPTPTPAPSQPAPAPEQDKIILQFGKVSKDMFTMDYRYPLSAFQAFAMCLSSFDTKLACE

SEQ ID NO: 4775 - protein, 452 aa, Secale cereale
MSFRSIVRDVRDGFGSLSRRSFEVTISGLTGLTGHHRGKCQSTVHELRDADLIVQESRWASLPPELLSDVIRRLEASESTWPSRKHVVSCAAVCKAWREMCREIVTSPEFCGKLTFPLSLKQPGPRDGMIQCYIKRDKSKSTYHLYLCLSNAVLVENGKFLLSAKRNRRTTCTEYVISMDAENISRSSSTYIGKLRSNFLGTKFVVYDTQPPYNGAMVPSVGRSSRRFNSKKVSPKVPSGSYNIAQVSYELNVLGTRGPRRMNCIMHSIPASSVEPGGIVPGQPDQIMPRALEDSFRSMSSFSKSSIMDRSTDFSSSRYFSSSRFLSDIAGGAISREEDGEHKERPLVLRNKVPRWHEQLQCWCLNFRGRVTIASVKNFQLIAAPSQPPPPLRGHRHRPRPRRSRPGAGAGQDHPAVRQGVQGHVHHGLPLPAVGVPGLRNVPEQLRHEAGL

SEQ ID NO: 4776 - protein, 454 aa, Secale cereale
MSFRSIVRDVRDGFGSLSRRSFEVTISGLTSLTGHHRGKCQSTVHELRDADLIVQESRWASLPPELLSDVIRRLEASESTWPSRKHVVSCAAVCKAWREMCREIVTSPEFCGKLTFPLSLKQPGPRDGMIQCYIKRDKSKSTYHLYLCLSNAVLVENGKFLLSAKRNRRTTCTEYVISMDAENISRSSSTYIGKLRSNFLGTKFVVYDTQPPYNGAMVPSVGRSSRRFNSKKVSPKVPSGSYNIAQVSYELNVLGTRGPRRMNCIMHSIPASSVEPGGIVPGQPDQIMPRALEDSFRSMSSFSKSSIMDRSTDFSSSRYFSSSRFLSDIAGGAISREEDGEHKERPLVLRNKVPRWHEQLQCWCLNFRGRVTIASVKNFQLIAAPSQPLPPAAGAPTPTPTPSQPAPAPEQDKIILQFGKVSKDMFTMDYRYPLSAFQAFAMCLSSFDTKLACE

SEQ ID NO: 4777 - protein, 442 aa, Secale cereale
MSFRSIVRDVRDGFGSLSRRSFEVTISGLTGLTGHHRGKCQSTVHELRDADLIVQESRWASLPPELLSDVIRRLEASESTWPSRKHVVSCAAVCKAWREMCREIVTSPEFCGKLTFPLSLKQPGPRDGMIQCYIKRDKSKSTYHLYLCLSNAVLVENGKFLLSAKRNRRTTCTEYVISMDAENISRSSSTYIGKLRSNFLGTKFVVYDTQPPYNGAMVPSVGRSSRRFNSKKVSPKVPSGSYNIAQVSYELNVLGTRGPRRMNCIMHSIPASSVEPGGIVPGQPDQIMPRALEDSFRSMSSFSKSSIMDRSTDFSSSRYFSSSRFLSDIAGGAISRDEDGEHKERPLVLRNKVPRWHEQLQCWCLNFRGRVTIASVKNFQLIAAPSQPRPPRGGTDTNPNPSQPARRRSRTRSSCSSARCPRTCSPWTTATRCRRSRPSQCA

SEQ ID NO: 4778 - protein, 436 aa, Elaeis guineensis
MSFRSIVRDVRDSFGSLSRRSFEVRLSGFSGHHKGKSQGSVYELQDQPPVIQQSRWACLPPELLCDVIKRLEASESTWPSRKNVVSCAAVCRSWREMCKEIVRSPEFCGKLTFPVSLKQPGPRDGTIQCFIKRDKSKLTYHLYLCLSPAVVVENGKFLLSAKRNRRTTCTEYIISMDAENISRSSNTYIGKLRSNFLGTKFIIYDTQPPYNGAALCPPPGRTSRRFYSKKVSPKVPSGSYNIAQVTYELNVLGTRGPRRMHCIMYSIPASALEPGGTVPGQPDNLIPRSLEDSFRSMSFSKSSIMDRSMDFSSSRFSDITGGIQEGDEEEENKEVRPLVLRNKPPRWHEQLQCWCLNFRGRVTVASVKNFQLIAATQPAAGAPTSSQPAPSEHDKIILQFGKVAKDMFTMDYRYPLSAFQAFAICLSSFDTKLACE

SEQ ID NO: 4779 - protein, 379 aa, Saccharum officinarum
MSFRSIVRDVRDSFGSLSRRSFEVTIAGLSGLTVHHRGKSQSTVHELRDTDLIIQESRWANLPPELLRDVIRRLEASESTWPNRKHVVSCAAVCRAWRELCREIVLSPEFSGKLTFPVSLKQPGPRDGMIQCFIKRDKSKSTYHLYLCLSTAVLMENGKFLLSAKRNRKTTCTEYIISMDADNISRSNSTYIGKLRSNFLGTKFMISDTQPPYSGAAVPHAGRTSRRFNSKKVSPKVPTGSYNIAQVTYELNVLGTRGPRRMHCVMHSIPASAVEPGGIVPGQPEQILPRALEESFRSTTSFSKSSIMDRSMDFSSSRDFSSARFSDIAGGAMADDEEGQNKERPLVLRNKAPRWHEQLQCWCLNFRGRVTIASVKNFS

SEQ ID NO: 4780 - protein, 433 aa, Musa acuminata
MSFRSIVRDVRDSFGSLSRRSFEVRLSSLSGHLRGKSQVFVPEPHDTPPVIQSSRWASLPPELLRDVIKRLEASEGTWPSRKDVVACAAVCRAWREMCKEIVRSPEFCGKLTFPISLKQPGTRDGMIQCFIKRDKSKLTYHLYLCLSPAVLVENGKFLLSAKRIRRTACTEYVISMDANNISRSTNTYIGKLRSNFLGTKFIIYDTQPPYNGAAICPPGRTSRRFYSKKVSPKVPSGSYSIAQVTYELNVLGTRGPRRMHCVMHSIPASALEPGGTVPGQPDSLVSRSLEESFRSMSFSKSIMDRSMDFSSSRFSDIIGGTQEGDEGGEAKERPLVLRNKPPRWHEQLQCWCLNFRGRVTVASVKNFQLIAASQPAAGAPTPSQPAPSEHDKIILQFGKVAKDMFTMDYRYPLSAFQAFAICLSSFDTKLACE

SEQ ID NO: 4781 - protein, 432 aa, Elaeis guineensis
MSFRSIVRDVRDSFGSLSRRSFEVRFSAFSGHYRGKSQGSVHELQDQPPVIQQSCWASLPPELLRDVIKRLEASESTWPSRKHVVACAAVCRSWREMCKEIVRSPEFNGKLTFPVSLKQPGPRDGTIQCFIKRDKSKLTYHLYLCLSSAVLVENGKFLLSAKRNRRTTCTEYIISMDADTISRSSNTYIGKLRSNFLGTKFIIYDTQPPYNGAALCPLGRTSRRFYSKKVSPKVPSGSYNIAQVTYELNVLGTRGPRRMHIIMHSIPASSLEPGGMVPGQPDHLLPRSLEDSFRSMSKSSLMDRSMDFSSSRFSDITGGTQEGDEEDENKERPLVLRNKAPRWHEQLQCWCLNFRGRVTIASVKNFQLIAATQPAAGAPTPSQPAPSEHDKVILQFGKVAKDMFTMDYRYPLSAFQAFALCLSSFDTKLACE

SEQ ID NO: 4782 - protein, 374 aa, Saccharum officinarum
MPYCEVGRHADGDKWEGVRLFYRRYGRGATKVLLIIGLAGTHDSWGPQIKGLTGSLEPADDEAVRPDEEAGVGAAGAAEAAPAEADEAVGGGDGIEVCCFDNRGVGRSSVLPNKSYYSTAIMAMDALALMDHLGWKKAHVFGHSMGAMIACKLAAMAPHRLCSLALLNVTGGGFQCFPKVDGQMLSLAFRFLRAKTPEERALVDLETHYTKEYLEETIGSCTRRMVLYQEYVKGISSTGMQSNCGFEGQVNACWTHKMTTKELDTIRSAGFLVSVIHGRYDIIAQLCHAKRLAERLLPVARMVELHGAHLVSHERPDEVNNALMDLIKATKSSMKPEEWSAQPENTSGVIVMGFEHMRNIVRVMKPVRVAAIES

SEQ ID NO: 4783 - protein, 376 aa, Zea mays
MPYCEVGRYADGDKWEGVRVYYRRYGRGATKVLLIIGLAGTHDSWGPQIKGLTGSLEPADDEALRPDEEAAGGDGDGIEVCCFDNRGAGRSSVPPNKSYYSTAIMATDALALMDHLGWKKAHVFGHSMGAMIACKLAAIAPHRLCSLALLNVTGGGFQCFPKVDGQMLSLAFRFLRAKTPEERALVDLETHYTKEYLEETVGSCTRRMVLYQEYVKGISSTGMQSNCGFEGQINACWTHNMTTKELDTIRSAGFLVSVIHGRYDIIAQLCHAKRLAESLLPVARMVELHGAHLVSHERPDEVNNALMDLIKATGSAMKPEEWSAQPENTSETGALISARPITVTMRTDEGVIVMGFEHIRNIVRIMKPARVAPIDS

SEQ ID NO: 4784 - protein, 289 aa, Setaria italica
MPYCEVGRYADGDKWEGVRLFYRRYGCGATKVLLIIGLAGTHDSWGPQIKGLTGSLEPADDEPPRPDEEAGAGAAGAAEAAPAEGDDAGGDGIEVCCFDNRGVGRSSIPPNKSYYSTAIMAKDALALMDHLGWKKAHVFGHSMGAMISCKLAAIAPHRLCSLALLNVTGGGFQCFPKVDGQMLSLAFRFLRAKTPEERALVDLETHYTKEYLEETVGSCTRRMVLYQEYVKGISSTGMQSNCGFEGQVNACWTHKMTTKELDTIRSAGFLISVIHGRYDIIAQLCHANV

SEQ ID NO: 4785 - protein, 417 aa, Panicum virgatum
MPYCEVGRYADGDKWEGVRLFYRRYGRGATKVLLIIGLAGTHDSWGPQIKGLTGSLEPADDEPPRPDEEAGAGAAGAAEAAPAEGGDAGGDGIEVCCFDNRGVGRSSVPPNKSYYSTAIMAKDALALMDHLGWKKAHVFGHSMGAMISCKLAAIAPHRLCSLALLNVTGGGFQCFPKVDGQMLSLAFRFLRAKTPEERALVDLETHYTKEYLEETVGSCTRRMILYQEYVKGISSTGMQSNCGFEGQVNACWTHNMSTKELETIRSAGFLISVIHGRYDIIAQLCHAKRLAERLLPAARMVELHGAHLVSHERPDEVNNALMDLIKATKSAVKPEEWSAQPENVSETGALISGRPITVTMRTDEGANATNAAVAVYNLLGKLQLSFLYLIGVIVMGFEHMRNIVKVMKPVRVAAIES

SEQ ID NO: 4786 - protein, 407 aa, Zea mays
MPYCEVGRYADGDKWEGVRLFYRRYGSGATKVLLVIGLAGTHDSWGPQIKGLTGSLEPSDDEALRPDEEAGVGAAEAAPAEADDGIEVCCFDNRGVGRSSVLPNKSYYSTAIMATDALALIDHLGWKKAHVFGHSMGAMIACKLAAMAPHRLCSLALLNVTGGGFQCFPKVDAQMLSLAFRFLRAKTPEERALVDLETHYTKEYLEETVGSCTRRMVLYQEYVKGISSTGMQSNCGFEGQVNACWTHKMTTKELDTIRSAGFLVSVIHGRYDIIAQLCHAKRLAERLLPVARMVVPHGAHLVSHERPDEVNNALMDLIKATKSEIKPEEWSAQPENTSETGALISARPITVMVRTDAGVDATAAVYNLLGKLQLSFLYLIGMILMGFELMRNIVRVMKPVRVAAIES

SEQ ID NO: 4787 - protein, 400 aa, Oryza sativa
MPYCEVDRYQNGDEWDGVRLFYRRFGRGATKVLLVIGLAGTHDSWGPQIKGLTGSLEPAADDEESGDAAAAEGDDGDGIEVCCFDNRGVGRSSVLPHKSYYSTVIMARDALALMDHLGWKKAHVFGHSMGAMISCKLAAMAPHRICSLALLNVTGGGFQCFPKLDGQMLSLAFRFLRARTPEERALVDLETHYTKEYLDEKVGSCTRRTILYQEYVKGISSTGMQSNCGFEGQVNACWTHNMTTKELDTIRSAGFLVSVIHGRSDIIAQLCHARRLAERLIPVARMVELHGAHLVSHERPEEVNNALMELIKATKSMMKPEEWSSQPENSSETGALISARPVSVTIRTDDGGNAAIAVYNLLAKLQLSFLYVIGVILMGFEHMRNIVKVMKPVRVAAIES

SEQ ID NO: 4788 - protein, 153 aa, Zea mays
MYQAIPYSAGRPWPRPAPAMGVEAAAAVAEEERLLAAAQQQQPSAGAEAAARGEEVRRAVAECPVLVVGKRGCCLSHVVKRLLQGLGVNPAVHEVADGAEAKLIAGVVDGGGDVALPAVFVGGRLLGGLDRLMAVHISGDLVPILKDAGALWL

SEQ ID NO: 4789 - protein, 146 aa, Saccharum officinarum
AIPYSAGRPWPQPAPAMGVDVAEEERLRAAAQQQQLAPAAEAEAAAREEEVRRAVAECPVLVVGRRGCCLSHVVKRLLQGLGVNPAVYEVADAEAELAGVVDGGGDVALPAVFVGGRLLGGLDRLMAVHISGDLVPILKDAGALWL

SEQ ID NO: 4790 - protein, 397 aa, Zea mays
MAIHLRAHAFAANPLRGVSAATTAMSPSAAAEALRYLLDPSSAAAAANPSQYLSKILPFRRGRPLARSTDPPAAPAWRLAWLPPSRVPGVAPDAFVFLGALVEGDGKEAAAYWAVDVSEGEGARVGGPADGDGPSAFVDLRTLMVATDWSDKDAMAELAIAGHARALLEWHSTAKFCGACGAKAVPTEAGRRKQCSNDSCKKRIYPRIDPVVIMLVIDKENDRALLSRQSRFVPRMWSCLAGFIEPGESLEEAVRRETWEETGIEVGQVVYHSSQPWPVGPNTMPCQLMVGFFAYAKSLEINVDKQELEDAQWHNREDVKKALTFAEYEKAQRTSAAKVDQICKGAEKGQNPSADFKVGSGEPAPMFVPGPYAIAHHLISSWAFEGAPKLPSSFSNL

SEQ ID NO: 4791 - protein, 404 aa, Panicum virgatum
MAIHLRAHAFAANPLRGVSASTTAVSPSAAAEALRSLLDPSSAAADAANPHPPHLSKILPFRRGRPLARSPDPPASAPPAAPAWRLAWLPPSRVPGVAPDAFVFLGAHAEGDGKEAAAYWAVDVSDGEGPRVDGGSGDGDGSAFVDLRTLMVATDWSDNDAMGDLAIAGHARALLEWHNTAKFCGACGAKAVPTEAGRRKQCSNESCKKRIYPRVDPVVIMLVIDKENDRALLSRQSRFVPRMWSCLAGFIEPGESLEEAVRRETWEETGIEVGQVIYHSSQPWPVGPNTMPCQLMVGFFAYAKSLEIHVDKQELEDAQWHSREDIKKALTFAEYENAQRTNALKVNQMCKGAEKGQSIAEDFKVGGGEPVPMFVPGPFAIAHHLISAWAFEGAPKVPSSFSNL

SEQ ID NO: 4792 - protein, 402 aa, Setaria italica
MAIHLRAHAFAANPLRGVSASTTAVSPSAAAEALRPLLDPSSPADAASPLPPHLSKILPFRRGRPLARSPDPPAPPPAAPAWRLAWLPPSRVPGVAPDAFVFLGAHAEGDGKEAAAYWAVDVSEGEGPRVDGGSGDGDGSAFVDLRTLMVATDWSDKDAMGDLAIAGHARALLEWHNTAKFCGACGAKAVPKEAGRRKQCSNESCKKRIYPRVDPVVIMLVIDKENDRALLSRQSRFVPRMWSCLAGFIEPGESLEEAVRRETWEETGIEVGQVIYHSSQPWPVGPNTMPCQLMVGFFAYAKSLEIRVDKQELEDAQWHSREDIRKALTFAEYEKAQRTNALKVNQMCKGAEKGQSITDDFKVDSGEPVPMFVPGPFAIAHHLISAWAFEGAPKLPSSFSNL

SEQ ID NO: 4793 - protein, 406 aa, Pennisetum glaucum
MAIHLRAHAFAANPLRGVSASTTAITPSAAADALRSLLDTSSAAAAADAAINPHPPHVSKILPFRRGRPLARSPDPPAQSPAAPAWRLAWLPPSRVPGVAPDAFVFLGAHAEGDGKEAAAYWAVDVTDGEGPRVDGSSGDGDASAFVDLRTLMVATDWSDKDAMGDLAIAGHGRALLEWHNTAKFCGACGANAVPKEAGRRKQCSNESCKKRIYPRVDPVVIMLVIDKENDCALLSRQSRFVPRMWSCLAGFLEPGESLEEAVRRETWEETGIEVGQVIYHSSQPWPVGPNTMPCQLMVGFFAYAKSLEICVDKKELEDAQWHSREDIKKALTFAEYEEARKTNALKVNQMCNDAEKGQSISDDLKVESGEPVPMFVPGPFAIAHHLISAWAFEGAPKVPSSFSNL

SEQ ID NO: 4794 - protein, 333 aa, Setaria italica
PPWPSTSAPTPSRRTRCGASRPPPPPSPPQRPPRLCAPSFSSPADAASPLPPHLSKILPFRRGRPLARSPDPPAPPPAAPAWRLAWLPPSRVPGVAPDAFVFLGAHAEGDGKEAAAYWAVDVSEGEGPRVDGGSGDGDGSAFVDLRTLMVATDWSDKDAMGDLAIAGHARALLEWHNTCGACGAKAVPKEAGRRKQCSNESCKKRIYPRVDPVVIMLVIDKENDRALLSRQSRFVPRMWSCLAGFIEPGESLEEAVRRETWEETGIEVGQVIYHSSQPWPVGPNTMPCQLMVGFFAYAKSLEIRVDKQELEDAQWHSREDIRKALTFAREPML

SEQ ID NO: 4795 - protein, 405 aa, Oryza sativa
MSIHLRAHAFAASPLRGLSASTAAVSPSAAADALRSLLDAGAGAADAAHPHPHPHLSKILPFRRGRPLARSYDSPPPPAAAAAAPPPPPAWRLAWLPPARVPDVPSDAFVFLGAHGEEEGKEAAAYWAVDVSERDGEGAGDGSAFVDLRTLMVATDWRDKDAMGDLAIAGHARALLEWHSTAKFCGACGSRAVPAEAGRRKQCSNESCKKRIYPRVDPVVIMLVIDKENDRALLSRQSRFVPRMWSCLAGFIEPGESLEEAVRRETWEETGIQVGEVIYHSSQPWPVGPSTMPCQLMVGFFAYAKSLEIHVDKKELEDAQWHSREDVKKALTFAEYEKAQRTNALKVNQICKGVEKRQSISADLKIESEEPAPMFVPGPYAIAHHLISSWAFEGAPKAPSSFSNL

SEQ ID NO: 4796 - protein, 401 aa, Triticum aestivum
MSIHLRAHAFAANPLRGLAGTRSSGAVSPSAAAEALRALLDGADAAAGHHLSRVLPFRRGRPLARSPDPPASSSSSPAPPPAWRLAWLPPSRVPGVPSDVFVFLGSHGGEGGGEEAAAYWAVDVSEVEGARFGGAGEGSAFVDLRTLMVAADWRDKDAMGELAIAGHARALLEWHNTAKFCGACGAKAVPTEAGTRKQCSNESCKKRIYPRVDPVVIMLVIDKQNDRALLSRQSRFVPRMWSCLAGFIEPGESLEEAVRRETWEETGIEVGQVIYHSSQPWPVGPNTMPCQLMVGFFAYAKSLDIHVDKKELEDAQWHSREDVKKALTFAEYEKAQRSSALKVNQICKGTERGQSTSSDLRVESEEPAPMFVPGPYAIAHHLISSWAFEGAPKVPSSFSNL

SEQ ID NO: 4797 - protein, 239 aa, Saccharum officinarum
EETERWTRRRSASTTATDGGAAEAYIERLPVDLLAHILSLLSPFRDLSMAGGVSRRWRWAVERALASRRRLSFAGQRTGNDTAARLIRAAVNLRDLDICWGCHITDEGLIKISSAGCVANLTSISLWGLAGITDKGVVHLVSRAYSLQHLNIGGTFITDESLYAVANSCTNLKSIILWSCRHVTEAGLVALVNKCRRLECINVGGMRVPPESFVGLLSISPALQIRSIPRILNAGVQVS

SEQ ID NO: 4798 - protein, 305 aa, Setaria italica
MARGCPHDRLIPTRPRRSRVPRRARVHSRRVALHASASRAGGDVWRYKKPPRPAGLSDQLLSPSVEREREMEQQQQLRDGDGGAAEGDIERLPADLLAHVLSLLPSFRDLSMAGGVSRRWRRAVERSLASRRRLSFAGQRTGDDTAARLVRAAVNLRDLDISRSCWGCQISDEGLIKISTADCVGKLTSISLWGLAGITDKGVVQLVSRAYSLQHLNIGGTFITDESLNAVANSCTDLKSIILWSCRHVTEAGLVALVNNCRRLECINVGGMRVPPESFVGLLSISPALRIRSIPQILNAGVQVS

SEQ ID NO: 4799 - protein, 231 aa, Pennisetum glaucum
MEQHLQLRDGDEGDIERLPADLLAHVLSLLPSFRDLSMAGGVSRRWRRAVERSLASRRRLSFAGQRTGDDTAARLVRAAVNLRDLDISRSCWGCQITDEGLIKISTADCVGKLTSISLWGLAGITDKGVVQLVSRAYSLKHLNIGGTFITDESLNAVANSCTNLKSIILWSCRHVTEAGLVALVNKCRRLECINVGGMRVPPESFVGLLSISPALQIRSIPHILNAGVQVS

SEQ ID NO: 4800 - protein, 116 aa, Panicum virgatum
MAARRRRTSSGSPPTSSRTSTPSSPPSATSPWRGGVSRRWRRAVELSLASRRPLSFAGQRTGDDTAARLVRAALNLHISRHLLGLPNHRRRLDQDFVRGLRREPDIHIAVGIGWNY

SEQ ID NO: 4801 - protein, 80 aa, Zea mays
MAEESGRPLPKFGEWDVNDPASADGFTVIFNKARDEKKGGNGQDTDSPSKDPRTERVESYAAKPSTKKWFCCVTASPTQS

SEQ ID NO: 4802 - protein, 102 aa, Triticum aestivum
MAEESGRPLPKFGEWDVNDPASADGFTVIFNKARDEKKGGNGQDTDSPSKDPRTERVGVLCCKTKHEEMVLLCDSQPYAILRKAIACAGKYCPFNFPIHTIP

SEQ ID NO: 4803 - protein, 80 aa, Zea mays
MAEESGRPLPKFGDWDVNDPASADGFTVIFNKARDEKKGGNGQDTESPSKDTRTERVESYAAKPSTKKWFCCVTASPTQS

SEQ ID NO: 4804 - protein, 80 aa, Panicum virgatum
MAEESGRPLPKFGEWDVNDPASADGFTVIFNKARDEKKGGNGQETDSPSKDTRTERVESYAAKPNSKKWFCCVTASPTQS

SEQ ID NO: 4805 - protein, 80 aa, Panicum virgatum
MAEESGRPLPKFGEWDVNDPASADGFTVIFNKARDEKKGGNGQDTESPSKDTRTERVESYAAKPNSKKWFCCVTASPTQS

SEQ ID NO: 4806 - protein, 80 aa, Pennisetum glaucum
MAEESGRPLPKFGEWDVNDPASADGFTVIFNKARDEKKGGNGQETDSPSKDTRTERVESYAAKPNSKKWFCCVTSSPTQS

SEQ ID NO: 4807 - protein, 80 aa, Setaria italica
MAEESGRPLPKFGEWDVNDPASADGFTVIFNKARDEKKGGNGQETESPSKDTRTERVESYAAKPNSKKWFCCVTSSPTQS

SEQ ID NO: 4808 - protein, 80 aa, Cynodon dactylon
MSEESGRPLPKFGEWDVNDPASADGFTVIFNKARDEKKGGNGQDTDSPCKDTRTERVESYAAKPNSKKWFCCVTSSPTQS

SEQ ID NO: 4809 - protein, 80 aa, Eragrostis curvula
MSEESGRPLPKFGEWDVNDPASADGFTVIFNKARDEKKGGNGQDTDSPCKDTRTERSESYAAKPNSKKWFCCVTSSPTQS

SEQ ID NO: 4810 - protein, 80 aa, Avena sativa
MSEESGRPLPKFGEWDVNDPASADGFTVIFNKARDEKKAGNGQDTESPCKDTRTERVESYATKANTKKWFCCVTPSPTQS

SEQ ID NO: 4811 - protein, 80 aa, Brachypodium distachyon
MSEESGRPLPKFGEWDVNDPASADGFTVIFNKARDEKKAGNGQDTESPCKDTRTERVESYAAKTNSKKWFCCVTPSPTQS

SEQ ID NO: 4812 - protein, 86 aa, Cenchrus ciliaris
IMTPAYLAEPNHQSLVRFCLFLNCLLCTMSAFCCLQKLVFTLLVDTYADTSSAMSASLISNNSSCLGTSSMSQYFTVMPLSVQNNK

SEQ ID NO: 4813 - protein, 73 aa, Triticum aestivum
  misc_feature (56)..(56): Xaa can be any naturally occurring amino acid
  misc_feature (70)..(70): Xaa can be any naturally occurring amino acid
  misc_feature (73)..(73): Xaa can be any naturally occurring amino acid
MAEESGRPLPKFGDWDVNDPASADGFTVIFNKARDEKKGGNGQDTESPSKDTRTEXVGILCCKAKHEEMXLLX

SEQ ID NO: 4814 - protein, 80 aa, Secale cereale
MSEESGRPLPKFGEWDVNDPASADGFTVIFNKARDEKKAGNGQDTESPSKDARTERVESYATKANSKKWFCCVTPSPTQS

SEQ ID NO: 4815 - protein, 80 aa, Oryza sativa
MSEEAGRPLPKFGEWDVNDPASADGFTVIFNKARDEKKGGNGQDTDSPCKETRTERVESYAPKTNSKKWFCCVTSSPTQS

SEQ ID NO: 4816 - protein, 80 aa, Unknown
  Sequence found in Organisms: Hordeum vulgare, Festuca arundinacea, Setaria italica, Triticum aestivum
MSEESGRPLPKFGEWDVNDPASADGFTVIFNKARDEKKAGNGQDTESPCKDARTERVESYATKANSKKWFCCVTPSPTQS

SEQ ID NO: 4817 - protein, 80 aa, Unknown
  Sequence found in Organisms: Secale cereale, Triticum aestivum
MSEESGRPLPKFGEWDVNDPASADGFTVIFNKARDEKKAGNGQDTESPGKDARTERVESYATKANSKKWFCCVTPSPTQS

SEQ ID NO: 4818 - protein, 88 aa, Lolium multiflorum
RGRGRGTSGSEESGRPLPKFGEWDVNDPASADGFTVIFNKARDEKKAGNGQDTESPCKDARTERVESYATKANSKKWFCCVTPSPTQS

SEQ ID NO: 4819 - protein, 80 aa, Triticum aestivum
MSEESGRPLPKFGEWDVNDPASADGFTVIFNKARDEKKAGNGQDTESPCKDARTERVEAYATKANSKKWFCCVTPSPTQS

SEQ ID NO: 4820 - protein, 104 aa, Secale cereale
PRRTENFPPNDPSGRSRTAALNPCRRKSGRPLRRSWRNGTSTTQLLLMDSQLYSTKTRDEKKAGNGQDTESPSKDARTERVESYATKANSKKWFCCVTPSPTQS

SEQ ID NO: 4821 - protein, 199 aa, Saccharum officinarum
MAYYGRDQRYGGYGGGIATPGYAPPVPYGMSQVNIEGDGCGRPLPPQPTVKVYCRANPNYAMTIRDGKVVLAPANPKDEYQHWIKDMRWSTSIKDEEGYPAFALVNKATGEAIKHSLGQSHPVRLVPYNPDFLDESVLWTESRDVGNGFRCIRMVNNIYLNFDALHGDKWHGGVRDGTDIVLWKWCEGDNQRWKIQPYY

SEQ ID NO: 4822 - protein, 195 aa, Triticum aestivum
MAYNGRDQRYGGGIATPGYAPPVPYGMSQVNIEGNGCGRPLPPQPTVKVYCRANPNYAMTIRDGRVVLAPANPKDEYQHWIKDMRWSTSIKDEEGYPAFALVNKATGEAIKHSLGQSHPVRLVPYNPDFLDESVLWTESRDVGNGFRCIRMVNNIYLNFDALHGDKWHGGVRDGTEIVLWKWCEGDNQRWKSSLG

SEQ ID NO: 4823 - protein, 264 aa, Zea mays
MHHQWGSWGRREQPAAPYKSAGPAVALSASGPLDHQSPEELLIEVSEVEKQAANKGTIVMDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNKATGEAIKHSLGQSHPVRLVPYNPDFLDESVLWTESRDVGNGFRCVRMVNNIYLNFDALHGDKWHGGVRDGTNVVLWKWCEGDNQRWKIQPYY

SEQ ID NO: 4824 - protein, 199 aa, Setaria italica
MDFYGGRERYGGGYGGIATPGYAPPVPYGMSQVNIEGKGCGRPLPPQPTVKVYCRADPNYAMTVRNGKVVLAPANPKDEYQHWIKDMRWSTSVKDEEGYPAFALVNKATGEAIKHSLGQSHPVRLVPYNPDFLDESVLWTESRDVGNGFRCVRMVNNIYLNFDALHGDKWHGGVRDGTEIVLWKWCEGDNQRWKIQPYY

SEQ ID NO: 4825 - protein, 198 aa, Panicum virgatum
MDVYSYGRDEQRYGGLATPGYAPPVPYGMSQVNIEGHGCGRPLPPQPTVKVYCRANPNYAMTVRNGKVVLAPANPKDDYQHWIKDMRWSTSVKDEEGYPAFALVNKATGEAIKHSLGQSHPVRLVPYNPDFLDESVLWTESRDVGNGFRCVRMVNNIYLNLDALHGDKWHGGVRDGTEIVLWKWCEGDNQRWKIQPYY

SEQ ID NO: 4826 - protein, 205 aa, Zea mays
MDGGYYGGRDQRYSGGYYGGGGIATPGYAPAVPYGMSQVNIEGNGCGRALPPQPTVKVYCRANPNYAMSVRDGKVVLAPANPKDEYQHWIKDMRWSTSIKDEEGYPAFALVNKATGEAIKHSLGQSHPVRLVPYNPDFLDESVLWTESRDVGNGFRCVRMVNNIYLNFDALHGDKWHGGVRDGTDVVLWKWCEGDNQRWKIQPYY

SEQ ID NO: 4827 - protein, 199 aa, Setaria italica
MDFYGGRERYGGGYGGIATPGYAPPVPYGMSQVNIEGKGCGRPLPPQPTVKVYCRADPNYAMTVRNGKVVLAPANPKDEYQHWIKDMRWSTSVKDEEGYPAFALVNKATGEAIKHSLGQSHPVRLVPYNPDFLDESVLWTESRDVGNGFRCVRMVNNIYLNFDALHGDKYHGGVRDGTEVVLWKWCEGDNQRWKIQPYY

SEQ ID NO: 4828 - protein, 196 aa, Avena sativa
MDYYRRHENYGGYGLATPGYAPPVPYGMSQVNIEGNCCGRPLPPQPTVKVYCRANPNYAMSVRNGKVVLAPANPKDEYQHWIKDMRWSTSVKDEEGYPAFALVNKATGEAIKHSLGQSHPVQLVPYNPDFLDESVLWTESRDVGNGFRCVRMVNNIYLNFDALNGDKYHGGVRDGTEIVLWKWCEGDNQRWKIQPY

SEQ ID NO: 4829 - protein, 201 aa, Cynodon dactylon
MDYYGRERHGGGYGGGYGVATPGYAPPVPYGMSQVNMEGNGCGRPLPPQPTVKVYCRANPNYAMSVRNGKVVLAPANPKDDYQHWIKDMRWSTNIKDEEGYPAFALVNKATGEAIKHSLGQSHPVRLVPYNPDHLDESVLWTESRDVGNGFRCIRMVNNIYLNFDALNGDKWHGGVRDGTEIVLWKWCEGDNQRWKIQPYY

SEQ ID NO: 4830 - protein, 197 aa, Avena sativa
MDYYRRHENYGGYGLATPGYAPPVPYGMSQVNIEGNCCGRPLPPQPTVKVYCRANPNYAMSVRNGKVVLAPANPKDEYQHWIKDMRWSTSVKDEEGYPAFALVNKATGEAIKHSLGQSHPVQLVPYNPDFLDESVLWTESRDVGNGFRCVRMVNNIYLNFDALNGDKYHGGVRDGTEVVLWKWCEGDNQRWQIQPYY

SEQ ID NO: 4831 - protein, 201 aa, Cynodon dactylon
MDYYGRERHGGGYGGGYGVATPGYAPPVPYGMSQVNMEGNGCGRPLPPQPTVKVYCRANPNYAMSIRNGKVVLAPANPKDDYQHWIKDMRWSTNIKDEEGYPAFALVNKATGEAIKHSLGQSHPVRLVPYNPDYLDESVLWTESRDVGNGFRCIRMVNNIYLNFDALHGDKAHGGVHDGTEVVLWKWCEGDNQRWKIQPYY

SEQ ID NO: 4832 - protein, 201 aa, Panicum virgatum
MDVYGGERYYGSYGGAGGLATPGYAPPVPYGMSQVNIEGHGCGRPLPPQPTVKVYCRANPNYALTIRNGKVVLAPANPKDDYQHWIKDMRWSTSVKDEEGYPAFALVNKATGEAMKHSLGQSHPVRLVPYNPDFLDESVLWTESRDVGNGFRCVRMVNNIYLNLDALHGDKWHGGVRDGTEIVLWKWCEGDNQRWKIQPYY

SEQ ID NO: 4833 - protein, 195 aa, Secale cereale
MDYYRESYGAYGMATPGYAPPVPYGMSQVNIDGNCGGRPMPPQPTVKIYCRANPNYAMSVRNGKVVLAPANPKDDYQHWIKDMRWSTSIKDEEGYPAFAMVNKATGQAIKHSLGQSHPVRLVPYNPDFLDESVLWTESRDVGNGFRCVRMVNNIYLNFDALNGDKYHGGVRDGTEVVLWKWCEGDNQRWKLQPYY

SEQ ID NO: 4834 - protein, 204 aa, Oryza sativa
MDFYGRREQYGGYGGYGGGGALATPGYAPAAPYGMSQVNIEGNGCGRTLPPQPTVKVYCRANPNYAMTARNGAVVLAPANPKDEYQHWIKDMRWSTSIKDEEGYPAFALVNKATGQAIKHSLGQSHPVRLVPYNPEVMDESVLWTESRDVGNGFRCIRMVNNIYLNFDAFHGDKYHGGVRDGTDIVLWKWCEGDNQRWKIQPYY

SEQ ID NO: 4835 - protein, 195 aa, Hordeum vulgare
MDYYRESYGSYGMATPGYAPPVPYGMSQVNVDGNCGGRPMPPQPTVKIYCRANPNYAMSVRNGKVVLAPANPKDDYQHWIKDMRWSTSIKDEEGYPAFAIVNKATGQAIKHSLGQSHPVRLVPYNPDFLDESVLWTESRDVGNGFRCVRMVNNIYLNFDALNGDKYHGGVRDGTEVVLWKWCEGDNQRWKIQPYY

SEQ ID NO: 4836 - protein, 195 aa, Triticum aestivum
MDYYRETYGGYGMATPGYAAPVPYGMSQVNIDGNYGGRPMPPQPTVKIYCRANPNYAMSVRNGKVVLAPANPKDDYQHWIKDMRWSTSIKDEEGYPAFAMVNKATGQAIKHSLGQSHPVRLVPYNPDYLDESVLWTESRDVGNGFRCVRMVNNIYLNFDALNGDKYHGGVRDGTEVVLWKWCEGDNQRWKLQPYY

SEQ ID NO: 4837 - protein, 204 aa, Festuca arundinacea
MDYYRRHENYGGYGMATPGYGMATPGYAPPVPYGMSQVNIEGNYGGRTLPPQPTVKVYCRANPNYAMSVRNGKVVLAPANPKDEYQHWIKDMRHSTSIKDEEGYPAFALVNKATGEAIKHSLGQSHAVRLVPYNPDFLDESVLWTESRDVGNGFRCVRMVNNIYLNFDALNGDKYHGGVRDGTEVVLWKWCEGDNQRWKIQPYY

SEQ ID NO: 4838 - protein, 204 aa, Festuca arundinacea
MDYYRRHENYGGYGMATPGYGMATPGYAPPVPYGMSQVNIEGNCGGRTLPPQPTVKVYCRANPNYAMSVRNGKVVLAPANPKDEYQHWIKDMRHSTSIKDEEGYPAFALVNKATGEAIKHSLGQSHAVRLVPYNPDFLDESVLWTESRDVGNGFRCVRMVNNIYLNFDALNGDKYHGGVRDGTEVVLWKWCEGDNQRWKIQPYY

SEQ ID NO: 4839 - protein, 190 aa, Pseudoroegneria spicata
ESYGAYGMATPGYAPPVPYGMSQVNIDGNGGGRPMPPQPTVKIYCRANPNYAMSVRNGKVVLAPANPKDDYQHWIKDMRWSTSIKDEEGYPAFAMVNKATGQAIKHSLGQSHPVRLVPYNPDFLDESVLWTESRDVGNGFRCVRMVNNIYLNFDALNGDKYHGGVRDGTEVVLWKWCEGDNQRWKIQPYY

SEQ ID NO: 4840 - protein, 195 aa, Triticum aestivum
MDYYRETYGGYGMATPGYAAPVPYGMSQVNIDGNCGGRPMPPQPTVKIYCRANPNYAMSVRNGKVVLAPANPKDDYQHWIKDMRWSTSIKDEEGYPAFAMVNKATGQAIKHSLGQSHPVRLVPYNPDYLDESVLWTESRDVGNGFRCVRMVNNIYLNFDALNGDKYHGGVRDGTEVVLWKWCEGDNQRWKLQPYY

SEQ ID NO: 4841 - protein, 193 aa, Triticum aestivum
YYRETYGGYGMATPGYAAPVPYGMSQVNIDGNYGGRPMPPQPTVKIYCRANPNYAMSVRNGKVVLAPANPKDDYQHWIKDMRWSTSIKDEEGYPAFAMVNKATGQAIKHSLGQSHPVRLVPYNPDYLDESVLWTESRDVGNGFRCVRMVNNIYLNFDALNGDKYHGGVRDGTEVVLWKWCEGDNQRWKLQPYY

SEQ ID NO: 4842 - protein, 550 aa, Triticum aestivum
PHTRGRSGIFQPKQRHDGTVAWLAACMSAALADPSSEPRTYQAAMRIPHWREAMEQEYQALLRNQTWTLVPPQSRVNVIDSKWVFKVKRHSDGSIERYKARLVARGFRQRFGLDYEDTFSLVVKPTTIRLLLSLAVTRGWFLRQLDVQNAFLHGVLAEEVYMRQPPGFSDPDRPDHLCRLSKAIYGLKQAPRAWHARLAMALRAHGFASSTADSSLFLLQRPEVTMYLLVYVDDIILVSSSQSAATALVRSLGADFAVKDLGKLHYFLGVEVTSRDAGLVMTQKKYSLDLLQRAGMLKCKPTTTPMSTTDKLNAVDGVLLSSSDATEYRSIVGGLQYLTITRPDISYAVNRVCQYLQSPRDTHWSAVKRILRYIRFTVAHGLHIRPSDSGCLSAYSDADWAGNPDDRRSTGGYAVFFGSNLIAWSARKQATVSRSSTEAEYKAVANATSEIIWVQSLLQELSIPQSQPPVLWCDNIGATYLSANPVFHARTKHIEVDYHFVRERVSQKQLQIKFISSKDQLADIFTKPLPLPQFETCRRNLTLLDSLESG

SEQ ID NO: 4843 - protein, 183 aa, Eragrostis curvula
MAYYGRESYGGYGGAIATPGYAPPAPYGMSQVNIEGNGCGRPLPPQPTVKVYCRANPNYAMSIRNGKVVLAPANPKDDYQHWIKDMRWSTTIKDEEGYPAFALVNKATGEAIKHSLGQSHPVRLVPYNPDYLDESVLWTESRDVGNGFRCVRMVNNIYLNFDALHGDKWHGGVRDGTEIVLWK

SEQ ID NO: 4844 - protein, 565 aa, Triticum aestivum
LRSPSPPPAPAAALRPHTRSRSGIFQPKQRHDGTVAWLAACMSAALADPSSEPRTYQAAMRIPHWREAMEQEYQALLRNQTWTLVPPQSRVNVIDSKWVFKVKRHSDGSIERYKARLVARGFRQRFGLDYEDTFSLVVKPTTIRLLLSLAVTRGWFLRQLDVQNAFLHGVLAEEVYMRQPPGFSDPDRPDHLCRLSKAIYGLKQAPRAWHARLAMALRAHGFASSTADSSLFLLQRPEVTMYLLVYVDDIILVSSSQSAATALVRSLGADFAVKDLGKLHYFLGVEVTSRDAGLVMTQKKYSLDLLQRAGMLKCKPTTTPMSTTDKLNAVDGVLLSSSDATEYRSIVGGLQYLTITRPDISYAVNRVCQYLQSPRDTHWSAVKRILRYIRFTVAHGLHIRPSDSGCLSAYSDADWAGNPDDRRSTGGYAVFFGSNLIAWSARKQATVSRSSTEAEYKAVANATSEIIWVQSLLQELSIPQSQPPVLWCDNIGATYLSANPVFHARTKHIEVDYHFVRERVSQKQLQIKFISSKDQLADIFTKPLPLPQFETCRRNLTLLDSLESG

SEQ ID NO: 4845 - protein, 182 aa, Hordeum vulgare
ATPGYAPPVPYGMSQVNVDGNCGGRPMPPQPTVKIYCRANPNYAMSVRNGKVVLAPANPKDDYQHWIKDMRWSTSIKDEEGYPAFAIVNKATGQAIKHSLGQSHPVRLVPYNPDFLDESVLWTESRDVGNGFRCVRMVNNIYLNFDALNGDKYHGGVRDGTEVVLWKWCEGDNQRWKIQPYY

SEQ ID NO: 4846 - protein, 199 aa, Brachypodium distachyon
MDYYRESSYGGGYGAMATPGYAPPVPYGMSQVNIDGCGAPRRPLPPQPTVKVYCRANPNYAMSVRDGKVVLAPANPRDDYQHWVKDMRWSTSVKDEEGYPAFALVNKATGQAIKHSLGQSHPVRLVAYNPEYMDESVLWTESRDVGNGFRCVRMVNNIYLNFDALNGDKYHGGVRDGTEVVLWKWCEGDNQRWQIKPYY

SEQ ID NO: 4847 - protein, 86 aa, Zea mays
MMEKQSREHQEGWRRQKQQQEEEVVMVMHSQVMRIKQEEDERAKVHETYQHHVSEMRRGLRDLDRQRSRSPLGRAARTAISIGGDS

SEQ ID NO: 4848 - protein, 120 aa, Saccharum officinarum
MAAAASSKGRAIAGSFVSRVLAGKAASPRRAVHASAYDKNLEEQVRPAFVPDDVIGGAGNPDKYWSPHPTTGVFGPAAVDPKLAAGGAPDAAANAAGGTVLDQKVWFRPLEDVEKPPPVA

SEQ ID NO: 4849 - protein, 120 aa, Zea mays
MAAAAGSKGRAIAGSFVSRVLAGKAASPRRAVHASAYDKNLEDQVRPAFVPDDVIGSAGSPDKYWSPHPKTGVFGPAAVDPKLAAGGAPDAGADAAGGTVLDQKVWFRPLEDVEKPPPAA

SEQ ID NO: 4850 - protein, 119 aa, Panicum virgatum
MAAAASFKGRAIAGSFVSRVLAGKAASPRRAVHASVYDKNLEDQVRPAFVPDDVIGGAANPDKYWAPHPRTGVFGPAAVDATLPAAGAPDAAADAPGTVLDQKVWFRPLEDVEKPPPVA

SEQ ID NO: 4851 - protein, 119 aa, Setaria italica
MAAAASSKGRAIAGSFVSRVLAGKAAASPRRAVHASAYDKNLEDQVRPAFVPDDVIGGAANPDKYWGPHPKTGVFGPAAVDANKAAGAPDAAANGAGSVLDQKVWFRPLEDVEKPPPAA

SEQ ID NO: 4852 - protein, 122 aa, Zea mays
MAAAASSKGRAIAGSFVSRVLAGKAASPRRAVHASSYDKNPEEQVRPAFVPDDVIGGAGSPDKYWSPHPKTGVFGPAAVDTNQLGVAADAAAANAAAAGGTVLDQKVWFRPLEDVEKPPPVA

SEQ ID NO: 4853 - protein, 89 aa, Setaria italica
MRRRNDENSVRVTNLSEDTREPDLLELFRAFGPVSRVYVAVDQKTGSSRGFGFVNFVHREDAEKAISKLNGYGYDNLILRVEWATPRPN

SEQ ID NO: 4854 - protein, 119 aa, Panicum virgatum
MAAAASFKGRAIAGSFVSRVLAGKATSPRRAVHASSYDKNLEDQVRPAFVPDDVIGGAANPDKYWGPHPKTGVFGPAAVDANLPAGGAPDAAADAPGTVLDQKVWFRPLEDVEKPPPVA

SEQ ID NO: 4855 - protein, 120 aa, Pennisetum glaucum
MAAAASFKGRAIAGSFVSRVLAGKAAAASPRRAVHASAYDKNLDDQVRPAFVPDDVIGGAANPDKYWSPHPKTGVFGPAAVDAAKAAGAPDAAANGPGSVLDQKVWFRPLEDVEKPPPAA

SEQ ID NO: 4856 - protein, 119 aa, Setaria italica
MAAAASSKGRAIAGSFVSRVLAGKAAALCRRAVHASAYDKNLEDQVRPAFVPDDVIGGAANPDKYWGPHPKTGVFGPAAVDANKAAGAPDAAANGAGSVLDQKVWFRPLEDVEKPPPAA

SEQ ID NO: 4857 - protein, 121 aa, Brachypodium distachyon
MAAVANSKGRAIAGNFVARILAGKAASPSRAVHASAYDKNVEEQVRPAFVPDDVIGGAAGSPDKYWGPHPTTGVFGPAAVDPKLAAAAGAPATAANGGGGSVLDQKVWFRPLEDVEKPPVA

SEQ ID NO: 4858 - protein, 118 aa, Cenchrus ciliaris
MAAAASSKGRAIAGSFVSRVLAGKAAAASPRRAVHASAYDKNLEDQVRPAFVPDDVIGGAANPDKYWGPHPKTGVFGPAAVDASSNAPDAAANGAGSVLDLKVWFRPLEDVEKPPPTA

SEQ ID NO: 4859 - protein, 120 aa, Triticum aestivum
MAAVASSKGRVIAGSLVARVLAGKANASPRRAVHASAYDKNVDEQVRPAFVPDDVIGGAGSPDKYWGPHPTTGVFGPAAVDPKLAASLAPASAAANGGASVLDQKVWFRPLEDVEKPPVA

SEQ ID NO: 4860 - protein, 120 aa, Triticum aestivum
MAAVASSKGRVIAGSLVARVLAGKANASPRRAVHASAYDKNVDEQVRPAFVPDDVIGGAGSPDKYWGPHPTTGVFGPAAVDPKLAATLAPASAAANGGASVLDQKVWFRPLEDVEKPPVA

SEQ ID NO: 4861 - protein, 119 aa, Triticum aestivum
MAAVASSKGRVIAGSLVARVLAGKANASPRRAVHASAYDKNVDEQVRPAFVPDDVIGGAGSPDKYWGPHPTTGVFGPAAVDPKLAASLAPASAAKGGPSVLDQKVWFRPLEDVEKPPVA

SEQ ID NO: 4862 - protein, 171 aa, Triticum aestivum
RNPLHPPVSEHEHSLSLSFTFVFLPLGSSTFAWQQWLAPGAGDRWEPRRARPRRQGQRLPEEGGARVGLRQERGRAGAPGLRAGRCDRRRREPRQVLGPSPHHRRLRPRRGRPQAGRHPRAGQRRREWWRLRAGPEGVVPPARGRREAPRRLIAGDHQDDDSPARHLYHSA

SEQ ID NO: 4863 - protein, 113 aa, Zostera marina
MAAAASFKGRAIAGSFVSRVLAGKATSPRRAVHASSYDKNLEDQVRPAFVPDDVIGGAANPDKYWGPHPKTGVFGPAAVDANLPAGGAPDAAADAPGTVLDQKVWFRPLEDVE

SEQ ID NO: 4864 - protein, 127 aa, Triticum aestivum
MAAVASSKGRVIAGSLVARVLAGKANASPRRAVHASAYDKNVDEQVRPAFVPDDVIGGAGSPNKYWGPHPTTGVFGPAAVDPKLAASLAPAAGAANGGASVLDQKCGSARSRTSRSPPSPDRQRRRP

SEQ ID NO: 4865 - protein, 122 aa, Hordeum vulgare
MAAVATSKGRVIAGSLVARVLAGKAANASPRRAVHASAYDKNVDEQVRPAFVPDDVIGGAGSPDKYWGPHPTTGVFGPAAVDPKLSASLAAPASAANGGGASVLDQKVWFRPLEDVEKPPVA

SEQ ID NO: 4866 - protein, 122 aa, Avena sativa
MAAVAGSKGRIAGNLVARVLAGNGKSASPRRAVHASAYDKNVDEQVRPAFVPDDVIGGPDSPDKYWGPHPTTGVFGPAVVDGKLVAAGAPVAAAANGTGGSVLDQKVWFRPLEDVEKPPPVA

SEQ ID NO: 4867 - protein, 122 aa, Avena sativa
MAAVAGSKGRIAGNLVARVLAGSGKSASPRRAVHASAYDKNVDEQVRPAFVPDDVIGGPDRPDKYWGPHPTTGVFGPAVVDGKLVAAGAPVAAAANGTGGSVLDQKVWFRPLEDVEKPPPVA

SEQ ID NO: 4868 - protein, 162 aa, Phaseolus vulgaris
MGGSWKLTCALLLLISAAATATDHIVGANRGWNPNINYTLWANNHTFYVGDLISFRYQKNQYNVFEVNQTGYDNCTTEGAVGNWTSGKDFIPLNKAKRYYFICGNGQCFSGMKVSVIVHPLPPPPTSALAAEHSTPNSASPLLFKRSLLLSSVLACFGFVWM

SEQ ID NO: 4869 - protein, 162 aa, Phaseolus vulgaris
MGGSWKLTCALLLLISAAATATDHIVGANRGWNPNINYTLWANDHTFYVGDLISFRYQKNQYNVFEVNQTGYDNCTTEGAVGNWTSGKDFIPLNKAKRYYFICGNGQCFSGMKVSVIVHPLPPPPTSALAAEHSTPNSASPLLFKRSLLLSSVLACFGFVWM

SEQ ID NO: 4870 - protein, 164 aa, Cajanus cajan
MARACSWELTCALLLLLCAVATATDHIVGANRGWNPGINYTLWANNHTFYVGDLISFRYQKNQYNVFEVNQTGYDNCTTEGAVGNWSSGKDFIPLNKAKRYYFICGNGQCFNGMKVSVIVHPLPSPPTSAEHSTPKSASPVLFKRSFHSLMLSFVLAWFGCVWI

SEQ ID NO: 4871 - protein, 159 aa, Cajanus cajan
SWELTCALLLLLCAVATATDHIVGANRGWNPGINYTLWANNHTFYVGDLIAFRYQKNQYNVFEVNQTGYDNCTTEGAVGNWSSGKDFIPLNKAKRYYFICGNGQCFNGMKVSVIVHPLPSPPTSAEHSTPKSASPVLFKRSFHSLMLSFVLAWFGCVWI

SEQ ID NO: 4872 - protein, 190 aa, Vigna unguiculata
  misc_feature (14)..(14): Xaa can be any naturally occurring amino acid
TRPKKYHKTTLNTXQNSNRTEQSRKEKEMRGSWKLTCSLILLISAVATATDHIVGANRGWNPGLNYTLWANNHTFYVGDLISFRYQKNQYNVFEVNQTGYDNCTTEGAVGNWSSGKDFIPLNKAKKYYFICGNGQCFSGMKVSVTVLPLPPPPTSAISAEHSTPHSASSLLFKRSLLLSSLLACFGSVFM

SEQ ID NO: 4873 - protein, 162 aa, Vigna unguiculata
MRGSWKLTCSLILLISAVATATDHIVGANRGWNPGLNYTLWANNHTFYVGDLISFRYQKNQYNVFEVNQTGYDNCTTEGAVGNWSSGKDFIPLNKAKKYYFICGNGQCFSGMKVSVTVLPLPPPPTSAISAEHSTPHSASSLLFKRSLLLSSLLACFGSVFM

SEQ ID NO: 4874 - protein, 187 aa, Glycine max
MALNQSKAVLLRVSLVVVALCIAGYIVGPPLYWHFVAVNNHSSSSTCAPCICDCSSQPILSIPQGLSNTSFGDCAKPDPEVSGDTEKNFAELLTEELKLQESQAVENQQRADMALLEAKKIASQYQKEADKCNSGMETCEEAREKAELTLVTQKKLTALWELRARQKGWKEGLAKSHAHSQGKVQSS

SEQ ID NO: 4875 - protein, 190 aa, Vigna unguiculata
MAMNQSKAVLLRVSLVVVALCIAGYIVGPPLYWHFVEGLAAVSHSSPSACAPCVCDCSSQPILSIPQGLSNTSFGDCAKSDPEVSGDTEKNFAELLTEELKLRENQAMENQQHADMALLEAKKIASQYQKEADKCNSGMETCEEAREKSELALVEQKKLTALWELRARQKGWKEGLAKSHARSQGKVQSS

SEQ ID NO: 4876 - protein, 190 aa, Phaseolus vulgaris
MAMDQSKAVVLRVSLVVVALCIAGYIVGPPLYWHFVEGLAAVSHSSPSTCAPCVCDCSSQPILSIPQGLSNTSFGDCAKSDPEVSKDTEKNFAELLTEELKLRENQAMESQQHADMALLEAKKIASQYQKEADKCNSGMETCEEAREKSELALVAQKKLTALWELRARQKGWKEGLAKSHAHSQGKVQSS

SEQ ID NO: 4877 - protein, 187 aa, Cajanus cajan
MNQSRAVLLRVSLVVVALCIAGYIVGPPLYWHFVEGLAALKHSSSACAPCICDCSSQPILSIPQGLSNSSFGDCAKADPEVGGDTEKNFAELLTEELKLRENQAVENQRHADMALLEAKKIASQYQKEADKCNSGMETCEEAREKAELALVAQKKLTALWELRARQKGWKEGLAKSHTHSQGKVQSS

SEQ ID NO: 4878 - protein, 190 aa, Phaseolus vulgaris
  misc_feature (175)..(175): Xaa can be any naturally occurring amino acid
MAMDQSKAVVLRVSLVVVALCIAGYIVGPPLYWHFVEGLAAVSHSSPSTCAPCVCDCSSQPILSIPQGLSNTSFGDCAKSDPEVSKDTEKNFAELLTEELKLRENQAMESQQHADMALLEAKKIASQYQKEADKCNSGMETCEEAREKSELALVAQKKLTALWELRARQKGWKEXLAKSHAHSQGKVQSS

SEQ ID NO: 4879 - protein, 186 aa, Lotus japonicus
MNQTGVAVLRVGLVVVALCIASYILAPPLYWHFREGLAAVKHSSSSCAPCLCDCSSQQPILSIPQGLSNTSFGDCAKPDPEVTGDTEKNFAELLSEELKLRENVALENQRRADMALLEAKKIASQYQKEADKCNSGMETCEGAREKAELALVAQKKLSALWELRARQKGWKEGVTKSQSQGKVQSS

SEQ ID NO: 4880 - protein, 191 aa, Cicer arietinum
MNNSRVMLLRVSLLVVAVCIAGYILGPPLYWHFKEGLAAVKHSSSSSSATCSPCLCDCSSQPTFSIPQGLSNISFGDCAKPDPEVNGDTEKNFAELLSEELKLRENEALENQRRADMALLEAKKIASQYQKEADKCNSGMETCEQAREKAELTLVAQKKLTALWELRARQKGWKEGVAKSNTQSQGKVQTS

SEQ ID NO: 4881 - protein, 193 aa, Arachis hypogaea
MATNNTGVILKIGLGVVALCIAGYIVGPPLYWHLMEGLLDVNHSSSPSSSSSCAPCLCDCSSQPILSIPQGLSNTSFGDCAKPDPEVSGDTEKNFGELLSEELKLRENQALEQQQHADMALLEAKKIASSYQKEADKCNSGMETCEEAREKAELTLVAQKKLTALWELRARQKGWKEGAAKSQGNVQTKLLRE

SEQ ID NO: 4882 - protein, 513 aa, Glycine max
MDQFLWRVLPLLTILVSFGVFFYLQDSYTAQLFPLIKLPRDKCSLLPHRHFWISSKRIVTPQGIISGSVEINDGKIISVVEGHAIQGKPKQEEVIDYGDAVIMPGLIDVHVHLNEPGRTEWEGFDTGTRAAAAGGVTTVVDMPLNCYPTTVSKEKLKLKLDAAEDKIYVDVGFWGGLIPENALNTSILDGLLSAGVLGVKSFMCPSGIDDFPMATIDHIKAGLSVLAKYRRPIVVHAEIQQDFENHLELNEDNLDPRAYLTYLNTRPPSWEEAAIKQLVSVTKDTRKGGPLEGAHVHIVHLSDSSASLDLIKEAKSHGDSISVETCPHYLAFTSEEIPNGDTRFKCSPPIRDAYNKDKLWEAVLEGHIDLLSTDHSPTVPELKLMEEGDFLKAWGGISSLQFNLPVTWSYGKKYGLTLEQLSLLWSKKPATLAGLESKGTIAVGNHADIVVWQPELEFDLDDDYPVFIKHSELSAYMGRRLSGKVLETFVRGNLVFKDGKHAPAPCGVQILAK

SEQ ID NO: 4883 - protein, 512 aa, Cajanus cajan
MEQLLWRVLPLLTILVSFIVFFYLQDSYRAQLYPIIKLPGGKCSLLPHRHFWITSKRIVTPQGIISGSVEINEGRIISVIEGNGKQGKSKQEEVIDYGDAVVMPGLIDVHVHLDEPGRTEWEGFDTGTRAAAAGGVTTVVDMPLNNQPTTVSKETLELKLEAAEDKIYVDVGFWGGLIPENALNTSILEGLLSAGVLGVKSFMCPSGIDDFPMTTIDHIKEGLSVLARYRRPLLVHSEIQQDSENRLELNDNRDPHDYLTYLNTRPPSWEQAAITELVGVTKDTRIGGPLEGAHVHIVHLSDSSASLDLIKEAKNRGDSLSVETCPHYLAFSSEEIPNGDTRFKCSPPIRDAFNKEKLWEAVLEGDIDLLSSDHSPTVPELKLLEEGDFLRAWGGISSLQFDLPVTWSYGKKYGLTLEQLSILWSKKPAAFAGLESKGAIAVGNHADIVVWHPELEFDLNDDHPVFLKHPSLSAYMGKRFSGKVLDTFVRGNLVFKDGKHAPAACGVPILAK

SEQ ID NO: 4884 - protein, 512 aa, Phaseolus vulgaris
MDQFIWRVLPLLSILVSFLVFFYFQNSHTAQLYPLIKFPRSKCSLLPHHHFWISSKRIVTPQGIISGSVEINEGRIVSVIEGYGKQGQSKQEEIIDYGDAVVMPGLIDVHVHLDEPGRTEWEGFDTGTRAAAAGGVTTVVDMPLNNYPSTVSKETLKLKLDAAEDKIYVDVGFWGGLVPENALNLTILDDLLSAGVLGVKSFMCPSGINDFPMTTIDHIKAGLSVLAKYKRPIVVHAELQQDYGNHLDINDNRDPHDYLTYLNTRPPSWEEAAIRQLVGVSKDTGIGGPLEGAHVHIVHLSDSSASLDLIKEAKSRGDSITVETCPHYLAFTSEEIPNGDTRFKCSPPIRDAHNKDKLWEAVLEGHIDLLTTDHSPTVPELKLLEEGDFLKAWGGISSLQFNLPVTWSYGKKYGLTLEQLSLLWSKRPAALAGIESKGTIEVGNHADIVVWQPEQEFDLDDNYPVFIKHYELSAYMGRRLSGKVLDTFVRGNLVFKDGKHAPAACGVQILAT

SEQ ID NO: 4885 - protein, 512 aa, Vigna unguiculata
MDQLVWRVLPLLTILVSFFLFFYFQNSHTAQLYPLIKLPRSKCSLLPHHHFWISSKRIVTPQGIISGSVEINEGRIVSVVEGYGNQGQSKQEEIIDYGDAVVMPGLIDVHVHLDEPGRTEWEGFDTGTRAAAAGGVTTVVDMPLNNYPTTVSKETLKLKLDAAEDKIYVDVGFWGGLVPENALNLTILDDLLSAGVLGVKSFMCPSGIDDFPMTTIDHIKAGLSVLAKYKRPIVVHSELQQDYGNDLVHDDNRDPHDYLTYLNTRPPSWEEAAIRQLVGVSKDTGIGGPLEGAHIHIVHLSDSSASLDLIKEAKSRGDSISVETCPHYLAFTSEEIPNGDTRYKCSPPIRDAQNKDKLWEAVLEGHIDLLTTDHSPTVPELKLLEEGDFLKAWGGISSLQFNLPVTWSYGKKYGLTIEQLSLLWSKRPAALAGIESKGTIAVGNHADIVVWQPEEEFDLDDNYPVFIKHYELSAYMGSRLSGKVLDTYVRGNLVFKDGKHAPAACGVQILAT

SEQ ID NO: 4886 - protein, 512 aa, Glycine max
MEQFVWRVLPLLTILMSLVVFFYLQDSYRAHLHPLVKLPRSKCSLLPHRHFWITSKRIVTPQGIISGSVEINEGKIISVIKGYSKQGKSKQEKIIDYGGAVVMPGLIDVHVHLDEPGRTAWEGFDTGTRAAAAGGVTTVVDMPLNNHPTTVSRETLKLKLEAAENKIYVDVGFWGGLIPENAHNTSILEGLLSAGVLGLKSFMCPSGISDFPLTTIHHIKEGLSVLAKYRRPLLVHSEIQQHSKKHLELNDKGGPRAYLTYLHTRPPSWEEAAIKELVGVTKDTRKGGPLEGAHVHVVHLSDSSASLDLIKEAKRRGDSISVETCPHYLAFSSEEIPNGDTRFKCSPPIRDAYNREKLWEAVLEGHIDLLSSDHSPTVPQLKLLEEGDFLKAWGGVTSLQFDLPVTWSYGKKHGLTLEQLSLLWSKKPATFAGLESKGAIAVGNHADIVVWKPEVEFDLNEDYPVFLKHPSLSAYMGRRLSGKVLETFVRGNLVFKKGKHAPSACGVPILAK

SEQ ID NO: 4887 - protein, 508 aa, Phaseolus vulgaris
MERFVWRVLPFLTFLVSFIVFFYLQDSYRAQLHPQVKLTENKCSLLHHRHFWITSKRIVTPQGIISGSVEIKEGNIISVIEGYGKQGNSKHEEVIDYGDAVVMPGLIDVHVHLDEPGRTAWEGFDTGTRAAAAGGVTTVVDMPLNNHPTTVSKETLKLKLEAAENRIYVDVGFWGGLIPENALNTSILEGLLSAGVLGLKSFMCPSGISDFPMTTIHHIKEGLSVLAKYRRPLYVHSEIQQHLELTDKGGPRTYLTYLHTRPPSWEEAAIKELVGVTKDTRIGGPLEGAHVHIAHLSDSSASLDLIKEAKSRGDSISVETCPHYLAFSSEEIPNGDTRFKCSPPIRDAYNKGKLWKAVLEGHIDLLSSDHSPTLPQLKLLEEGDFLKAWGGISSLQFDLPVTWSYGKKHGLTLEHLSLLWSKKPATFAGIESKGSIAVGNHADIVVWKPEVEFELNEHYPVFLKHPSLSAYMGRRLSGEVLETFVRGNLVFKKGKHAPAACGVPILAK

SEQ ID NO: 4888 - protein, 509 aa, Lotus japonicus
MEPLLWRVLPMLALLVSFILFFYFQDSHLSPLTKLAGDGCSLLPHRHYWITSKRIVTPQGIISGSVEINEGKIVSITEGYGKQGNSKQEVVIDYGEAVIMPGLIDVHVHLDEPGRTEWEGFVTGTRAAAAGGVTTVVDMPLNNHPTTVSQETLQLKLEAAENELHVDVGFWGGLVPENALNTSILEGLLSAGVLGLKSFMCPSGINDFPMTTIDHIKEGLSVLAKYRRPLLVHAEIQQDSKNNLELKGNDDPRVYSTYLNTRPPSWEEAAIKELVDVTKDTIHGGPLEGAHVHIVHLSDSSVSLDLIKEAKLRGDSISVETCSHYLAFSSEEIPDGDTRFKCSPPIRDAFNKEKLWEAVLEGHIDLLTSDHSPTVPELKLLKEGDFLKAWGGISSLQFDLPVTWSYGKKHGLTLEQLSLLWSQKPATLAGIASKGAIVVGNHADIVVWHPELEFELNDDYPVFLKHPNLSAYMGRRLSGKVLDTFVRGNLVFKDGKHAPAACGVPILAK

SEQ ID NO: 4889 - protein, 511 aa, Trigonella foenum-graecum
MDQLLWRVLPLSALVISFSLFFYLQGSNNAQFSSLIKLKRGECSLLPYNHYWISSNRIFTSQGFISGSVEINEGKIVSIVEGYDKQRNSVEQVIDYGEAVVMPGLIDVHVHLDEPGRTDWEGFVTGTQAAAAGGVTTVVDMPLNNHPTTVSKETLELKLEAAEDKIYVDVGFWGGLIPENALNTSILEGLLGAGVLGLKSFMCPSGINDFPMTTIEHIKEGLSVLAKYRRPLLVHSEIEQDSKSHSELEGNGDPHAYKTYLDTRPPSWEEAAIKELVDATKDTRVGGSLEGAHVHIVHLSDSSASLDLIKEAKRRGDSISVETCPHYLTFSSEEIPDKDTRYKCSPPIRDALNKEKLWEALLDGHIDLLSSDHSPTVPELKLLKEGDFLKAWGGISSLQFNLPVTWSYGKKHGLTLEQLSLLWSQKPATLSGLELKGAIAVGNHADIVVWQPEVEFDLNDDYPVFLKHPSLSAYMGRRLSGKVLDTFVRGNLIFKDGKHAPAACGVPILAK

SEQ ID NO: 4890 - protein, 515 aa, Arachis hypogaea
MDNFVWRVLPLFALLVAFVTFFYLQDSYKAQFSPFIKLPVDDDNECSLLPFRHYWISSKRILTPQGFISGSVEINEGKIVSVVEGYGKQGNSRQEEVIDYGEAVVMPGLIDVHVHLDEPGRTEWEGFVTGTRAAAAGGVTTVVDMPLNNHPTTVSKETLELKLEAANKKLHVDAGFWGGLVPENALNTSILDGLLSAGVLGVKSFMCPSGINDFPMTTIDHIKEGLTVLAKYKRPLIVHAEIQLDSESHSELKDNRDPRVYLTYLNTRPPSWEQAAIKELVGVTKDTIVGGPLEGAHVHIVHLSDSSLSLDMIKEAKRRGDSISVETCSHYLAFSSEEIPDGDTRFKCSPPIRDAHNREKLREAVLEGHIDFLTSDHSPTVPELKLLEEGDFLRAWGGISGLQFDLPVTWSYGKKYGLTLEQLSLLWSKKPAAFAGIESKGTIAVGYHADIVVWQPEVEFDVNENYPIFLKHPSLSAYMGTRLSGKVLDTFVRGNLVFKEGKHASAACGVPILAK

SEQ ID NO: 4891 - protein, 504 aa, Medicago truncatula
MDQLLWRVLPLLTLLISFSLFFYLQSPIIKLPGDECSLLPYSHYWISSKRILTSQGFISGSVEINEGKIVSIVEGYGKKDNSVHQVIDYGDAVVMPGLIDVHVHLDEPGRTDWEGFVTGTQAAAAGGVTTVVDMPLNNHPTTMSKETLELKLEAAEDKIYVDVGFWGGLVPENAQNTSILEGLLDAGVLGLKSFMCPSGIDDFPMTTIEHIKEGLSVLAKYRRPLLVHSEIQQDSESSSELEGNGDPHSYKTYLDTRPPSWEEAAIKELVDATKDTRIGGSLEGAHVHIVHLSDSSASLDLIKEAKRRGDSISIETCPHYLTFSSEEIPDKDTRYKCSPPIRDASNREKLWEALLDGHIDLLSSDHSPTVPKLKLLKEGDFLKAWGGISSLQFDLPVTWSYGKKHGLTLEKLSLLWSQKPAKLAGLESKGAIAVGNHADIVVWQPEVEFDLNDDYPVFIKHPSLSAYMGSRLAGKVLDTFVRGNLVFKDGKHAPAACGVPILAK

SEQ ID NO: 4892 - protein, 393 aa, Solanum phureja
MVQPHVLLVTFPAQGHINPSLQFAKRLIKMGIEVTFTTSVFAHRRMAKTAASNAPKGLNLAAFSDGFDDGFKSNVDDSKRYMSEIRSRGSQTLRDIILKSSDEGRPVTSLVYTLLLPWAAEVARELHIPSALLWIQPATVLDIYYYYFNGYEDEMKCSSNDPNWSIQLPRLPLLKSQDLPSFLVSSSSKDDKYSFALPTFKEQLNTLDGEENPKVLVNTFDALELEPLKAIEKYNLIGIGPLIPSSFLGGKDSLESSFGGDLFQKSNDDYMKWLNTKPKSSIVYISFGSLLNLSRNQKEEIAKGLIEIKRPFLWVIRDQENIKEVEKEEEKLSCMMELEKQGKIVPWCSQLEVLTHPSLGCFVRLALWMEFDSGEPVVRRTCGGISSLDRSRD

SEQ ID NO: 4893 - protein, 470 aa, Capsicum annuum
MSRPHILLVTFPTQGHINPSLQFAKRLIKLGIEVTFATSVSAHRRMAKTAACTLPEGLNFEAFSDGYDDGFKCDVDDSERYMSEIRSRGSQTIKDIILKSSDEERPVTSLVYTLLLPWAAEVARELHVPSALLWIQPATVLDIYYYYFNGYEDEMKCNTNDPNWCIQLPRLPLLKSQDLPSFIASSSSKDEKYSFALPTFKEQLDTLDGEENPKVLVNTFDALELDALKAIEGYNLIGIGPLIPSSFLDGKEPLDSSFGFDLFQKSNDDYMEWLDSNPKSSIVYISFGSLLNLSRNQKEEIARGLIEIKRPFLWVIRDEENAKEVENEQEKLSCMMELEKQGKIVPWCSQLEVLTHPSIGCFVSHCGWNSTLESLSTGVPVVAYPHWTDQGTNAKLIEDVWKTGVRLRVNGDGVVDSEEIKRCIEIVMNNGEEMRKNAQKWKELAREAVKEGGSSQMNLKAFVQQVGKGC

SEQ ID NO: 4894 - protein, 470 aa, Nicotiana tabacum
MVQPHVLLVTFPAQGHINPCLQFAKRLIRMGIEVTFATSVFAHRRMAKTTTSTLSKGLNFAAFSDGYDDGFKADEHDSQHYMSEIKSRGSKTLKDIILKSSDEGRPVTSLVYSLLLPWAAKVAREFHIPCALLWIQPATVLDIYYYYFNGYEDAIKGSTNDPNWCIQLPRLPLLKSQDLPSFLLSSSNEEKYSFALPTFKEQLDTLDVEENPKVLVNTFDALEPKELKAIEKYNLIGIGPLIPSTFLDGKDPLDSSFGGDLFQKSNDYIEWLNSKANSSVVYISFGSLLNLSKNQKEEIAKGLIEIKKPFLWVIRDQENGKGDEKEEKLSCMMELEKQGKIVPWCSQLEVLTHPSIGCFVSHCGWNSTLESLSSGVPVVAFPHWTDQGTNAKLIEDVWKTGVRLKKNEDGVVESEEIKRCIEMVMDGGEKGEEMRRNAQKWKELAREAVKEGGSSEMNLKAFVQEVGKGC

SEQ ID NO: 4895 - protein, 408 aa, Solanum tuberosum
MSFGETKTVTPTEPSTEAARRRRMEIHQFRFVASDMAVAPPTSMENGGRKRQKLEKTVSVKSYDSKEKKRFKLERIVSLPLSLPCTSEIEMGEKKVAENKETETNALDLTESSSNIERQGVSDCPKFGMTSVCGRRRDMEDTVSIYPSFLQDKHEKSSNLHFFGLYDGHGCSHAAMKCKDGMHEIVKNEVESAGEEATWKEMMIQSFSKMDKEVVEYSKGAGGTQTTDCRCELQTPQCDAVGSTAVVAVLTPNKIVVSNCGDSRAVLCRNGVPIPLSTDHKPDRPDELNRIEEAGGRVIYWDGARVLGVLAMSRAIGDSYLKPYVTSEPEVTITERTVEDECLILASDGLWDVVSNETACGVARMCLRSGQSSDQACTDASILLTRLALARHSSDNVSVVVVDLKRGL

SEQ ID NO: 4896 - protein, 410 aa, Solanum phureja
MSFGETKTVTPTEPSTEAARRRRMEIHQFRFVASDMAVAPPTSMENGGRKRQKLEKTVSVKSYDSKEKKRFKLERIVSLPLSLPCTSEIEMGKKKLAENKETETNALDLTESASISLNIERQGVSDCPKFGMTSVCGRRRDMEDTVSIYPSFLQDKHEKSSNLHFFGLYDGHGCSHAAMKCKDRMHEIVKNEVESAGEATWKEMMSQSFSKMDKEVVEYSKGAGGTHTVDCRCELQTPQCDAVGSTAVVAVLTPNKIVVSNCGDSRAVLCRNGIPIPLSTDHKPDRPDELNRIEEAGGRVIYWDGARVLGVLAMSRAIGDSYLKPYVTSEPEVTITERTVEDECLILASDGLWDVVSNETACGVARMCLRSGQSSDQACTDASILLTRLALARHSSDNVSVVVVDLKGGL

SEQ ID NO: 4897 - protein, 428 aa, Nicotiana benthamiana
MTGMYFGETKTVNPTEPSSEGARRRRMEVHQFRFIASDTAVAPPLESERKRQKLNKLVSVKSFEIKEKRSKLERIVSLPLSLPCRSDIEKGEKKVTENKETERNALDLTDSASISSNIERRGVSDCPKFGVTSVCGRRRDMEDAVSIYPTFIQEKHEKSSNLHFFGLYDGHGCSHAAMKCKDRMHDIVKNEVESAGEATWKEMMMRSFTKMDEEVVEYSRGGGGAPTADCRCELQTPQCDAVGSTAVVAVVTPNEIVVSNCGDSRAVLCRNGVAIPLSTDHKPDRPDELSRIEEAGGRVIYWDGARVLGVLAMSRAIGDNYLKPYVTSEPEVTVTERTVDDECLILASDGLWDVVSNETACGVARMCLRSGRPESPPGSPANDVTPTVSGDNSEQACTDASILLTRLALARHSSDNVSVVVVDLKRDL

SEQ ID NO: 4898 - protein, 428 aa, Nicotiana benthamiana
  misc_feature (328)..(328): Xaa can be any naturally occurring amino acid
MTGMCFGETKTVNPTEPSSEGARRRRMEVHQFRFLASGMAVAPPLESERKRQKLNKLVSVKSFEIKEKRSKLERIVSLPLSLPCISDIDKGEKKVGENKETERNALDLSESASISSNIERPGVSDCPKFGVTSVCGRRRDMEDAVSIYPTFIQEKHVTSRNLHFFGLYDGHGCSHAAMKCKDRMHDIMKYEVESAGEATWKEMMTRSFTKMDKEVVEYSRGGGGAPTADCRCELQTPQCDAVGSTAVVAVVTPNEIVVSNCGDSRAVLCRNGVAIPLSTDHKPDRPDELNRIEEAGGRVIYWDGARVLGVLAMSRAIGDNYLKPYVTXEPEVTITERTVDDECLILASDGLWDVVSNETACGVARMCLRSGRPQFPPGSPANDVTPTVSGDNSDQACIDASIFLTRLALARHSSDNVSVVVVDLKRDL

SEQ ID NO: 4899 - protein, 387 aa, Solanum phureja
MSFIKPSSRYAKTSFDSSRSSTKSDPSSSTDKALIKIKKGSNGVTQTTHQSNFSSMVKKFVEHKSASSKLMKQQQQQKKGDLKLVIPVDFIAEDLKKTAKRGSGLSSLHKKLFKGSSSGGGVKKEEGSAMKALTEVKGNTRTLGMVLRSERELLSMNKEQEDQIVELKLMLEEKNREVEKLKDLCLKQREEIKSLKNSILFPDVMNYQVQDLLEKQGSELKQAKQLIPNLQRQVTSLTGQLQCLAEDLAEIKADKYAIRGSYDSFGSPPEYDQEEAANSLEFSSEDHTIPGSPDDMFLKDVNPCLTPYYAKTKSKEFDDFNSPDAKDLVKNNIQVYHETSYNSCARKLSKSSDCRQCSNTGNKATRAARRSDESKCTYGKQVHNKFY

SEQ ID NO: 4900 - protein, 156 aa, Unknown
  Sequence found in Organisms: Solanum tuberosum, Solanum phureja
MADVQRRGRPLPPPPPRGPLGPPPQRIAPRPVPVDREKTCPLLLRVFTKVGGHHNVNEFAVRGKEPKDEVQIYTWMDATLRELTDLVKEVAPEARRRDAILSFAFVYPDKRGRFVVREVGTTFSYPNMRRPDNGSKTLSELKFQIGDYLDVAIMFQ

SEQ ID NO: 4901 - protein, 153 aa, Solanum melongena
MADVQRRGRPLPPPPPRGLPPQRIAPRPVPVDREKTCPLLLRVFTKVGGHHNVNEFAVRGKEPKDEVQIYTWMDATLRELTDLVKEVAPEARRRDATLSFAFVYPDKRGRFVVREVGSTFSYPNMRRPDNGSKTLSELKFQIGDYLDVAILFQ

SEQ ID NO: 4902 - protein, 157 aa, Capsicum annuum
MADVQRRGRPLPPPPPRGGPLGPPLARIPPRPVPVDREKTCPLLLRVFTKVGGHHNKNEFAVRGKEPKDEVQIYTWMDATLRELTDLVKEVAPEARRRDATLSFAFVYPDKRGRFIVSEVGRTFSYPNIRRPDDGSKPLSELKFQIGDYLDVAIMFQ

SEQ ID NO: 4903 - protein, 156 aa, Nicotiana tabacum
MAEVQRRGRPLPPPPARVPPGPPPLRMGPRVQPVDREKTCPLLLRVFTKIGGHHSDNDFAVRGKEPKDEVQIYTWMDATLRELTDLVKEVAPEARRRDASLSFAFVYPDKRGRFVVREVGRTYSYPNGRRPDSGSKSLSELKFQIGDYLDVAITFQ

SEQ ID NO: 4904 - protein, 157 aa, Olea europaea
MAEVQRRPGGRPLPPSARGPPPPPATKPGPRSEPVDREKTCPLLLRVFTKVGGHHTDGEFAVRGKEPKDEVQIYTWMDATLRELTDLVKEVAPEARRRDAILSFAFVYPDKRGRFVVREVGRTFSYPNGRRPDSGSKSLSELCFQIGDYLDVAILLQ

SEQ ID NO: 4905 - protein, 159 aa, Petunia hybrida
MAQDQRRGRPLPPPPARGPLGPPPFRMAPRLEPVDREKTCPLLLRVFTKVGGHHSDNDFAVRGKEPKDEVQIYTWMDATLRELTDLVKEVAPEARRRDAELSFAFVYPDKWGKFVVRQVGRTNSYLNARRADNGRATLSELKFQIGDYLDVAITFQDRF

SEQ ID NO: 4906 - protein, 152 aa, Nicotiana tabacum
  misc_feature (6)..(6): Xaa can be any naturally occurring amino acid
  misc_feature (11)..(11): Xaa can be any naturally occurring amino acid
  misc_feature (18)..(18): Xaa can be any naturally occurring amino acid
GGRREXITSSXTERPAWXTPARLAPRLQPVDREKTCPLLLRVFTKIGGHHSDNEFAVRGKEPKDEVQIYTWMDATLRELTDLVKEVAPEARRRDATLSFAFVYPDKRGQFVVREVGRTFSYPNMRRPDSGSKTLSELKFQIGDYLDVAILFQ

SEQ ID NO: 4907 - protein, 157 aa, Orobanche aegyptiaca
MADVQRRRGLPPPPPLRGLPPPPASKPSVLRPEPVDREKTCPLLLRVFTKVGGHHTDDDFAVRGKEPKDEVQIYTWMDATLRELTDLVKEVAPEARRRDALLSFAFVYPDKRGRFVVREVGRTFSYPNGRRPDSGSKALGDLSFQIGDYLDVAILTQ

SEQ ID NO: 4908 - protein, 158 aa, Amsonia hubrichtii
MAEVQRRAGGRPLPPVGRGPPPPPPSAKAAPRFEPVDREKTCPLLLRVFTKIGGHHTEGEFAVRGKEPKDEVQIYTWMDATLRELTDLVKEVASEARRRDAILSFAFVYPDKRGRFVVREVGRTFSQPNARRPDQGSKALGELNFQIGDYLDVAILLQ

SEQ ID NO: 4909 - protein, 157 aa, Sesamum indicum
MAEGQRRPGRQMPPPGRGPPPPPPAKPAAPRLEPVDREKTCPLLLRVFTKVGGHHSDEDFAVRGKEPKDEVQIYTWMDATLRELTDLVKEVAPEARRRDAILSFAFVYPDKRGRFVVREVGRTFSYPNGRRPDSGSKALGDLSFQIGDYLDVAILTQ

SEQ ID NO: 4910 - protein, 157 aa, Triphysaria pusilla
MADVQRRRGPLPPPPGRGLPPPPITKPAAPRPEPVDREKTCPLLLRVFTKVGGNHTDDDFAVKGKEPKDEVQIYTWMDATLRELTDLVKEVAPEARRRDAILSFSFVYPDKRGRFVVREVGRTLSYPNGRRPDSGSKALCDLSFQVGDYLDVAILTQ

SEQ ID NO: 4911 - protein, 158 aa, Antirrhinum majus
  misc_feature (7)..(7): Xaa can be any naturally occurring amino acid
KVSDDGXAIRAGRPMPPPGRGPPPPPPLSKAPVPVVDREKTCPLLLRVFTKVGAHHTDGDFAVRGKEPKDEVQIYTWMDATLRELTDLVKEVAPEARRRDAILSFAFVYPDKRGRFVVREVGRTFSYPNGRRPDNGSKALGELSFQVGDYLDVAILTQ

SEQ ID NO: 4912 - protein, 158 aa, Lippia dulcis
MAEIQRRPGRGPMAPPGRGLPPPPAARPAPRPEPVDREKTCPLLLRVFTKVGGHHTDEDFAVRGKEPKDEVQIYTWMDATLRELTDLVKEVAPEARRRDAMLSFAFVYPDKRGRFVVREVGRTFSYPNARRPDSGSKALGDLSFQIGDYLDVAITLPQ

SEQ ID NO: 4913 - protein, 245 aa, Solanum phureja
MSTDVHSNSKAFKIFIGYDPHEDVAYEVCRYSLLKRSSIPLEIIPIKQSELREKGLYWRERGKLESTEFSFSRFLTPHLANFEGWAMFVDCDFLYLGDIKELRDMVDDKYALMCVQHNYAPKETTKMDGAVQTVYPRKNWSSMVLYNCGHPKNKVLTPEIVNTESGAFLHRFTWLEDEEIGEVPFVWNFLVGHNKVVEGDPATFPKSIHYTLGGPWFEAWKDCEFGDLWIKELEEYKKAAEKKVD

SEQ ID NO: 4914 - protein, 255 aa, Capsicum annuum
MSTVVHSNGNGHSQNAPNSKPFKIFIGYDPREDVAYEVCRYSLLKRSSIPLEIIPIKQSELRGKELYWRERGKLESTEFSFSRFLTPHLANFEGWAMFVDCDFLYLGDIKELRDMVDDKYALMCVQHDYAPKETTKMDGAVQTVYPRKNWSSMVLYNCGHPKNKVLTPEIVNTESGAFLHRFTWLEDGEIGEVPFVWNFLVGHNKFVEGDPATFPKAIHYTLGGPWFEAWKDCEFGDLWLKELEEYKKATEKKLD

SEQ ID NO: 4915 - protein, 251 aa, Petunia hybrida
MSNDGHVDSQNGPNSKAFKVFIGYDPREDDAYEVCKYSLLKRSSIPLEIIPIKQSELRQKGLYWRERGKLESTEFSFSRFLTPNLANYEGWAMFVDCDFLYLGDIKELVNMVNDKYAVMCVKHDYAPKETTKMDGAVQTVYPRKNWSSMVLYNCGHPKNKVLTPEIVNTESGAFLHRFTWLDDKEIGEVPFVWNFLVGHSKVVEGDPSTFPKAIHYTLGGPWFEAWKDCEFGDLWVKELEEYKKATVKKVD

SEQ ID NO: 4916 - protein, 251 aa, Solanum lycopersicum
MSKDLHSDVEKSETPLKPFKIFVGYDPREDVAYEVCRYSLLKRSSIPLEITPIKQCELREQGLYWRERGKLESTEFSFSRFLTPYLADYEGWAMFVDCDFLYLGDIKELRDIVDDKYALMCVQHDYTPKETTKMDGAVQTVYPRKNWSSMVLYNCGHPKNRGLTPEVVNAESGAFLHRFMWLEDEEIGEVPFVWNFLVGHNKVVEGDPATFPKAIHYTLGGPWFEAWKDCEFGDLWLKELEESKKAKEKVV

SEQ ID NO: 4917 - protein, 271 aa, Capsicum annuum
MSSTVKSLYSNGVDVTKSETPFVVSDPILSNGTKNSKPFKIFIGYDPREDVAYEVCRYSLLKRSSIPLEITPIKQSELRQQGLYWRERGKLESTEFSFSRFLTPHLADYEGWAMFVDCDFLYLGDIKELRDRVDDKYALMCVQHDYTPKETTKMDGAVQTVYPRKNWSSMVLYNCGHPKNRALTPEVVNSESGAFLHRFMWLEDEEIGEVPFVWNFLVGHNKVVEGDPATLPKAIHYTLGGPWFEAWKDCEFGDLWLKELEECKKAKGKVG

SEQ ID NO: 4918 - protein, 250 aa, Ipomoea nil
MNTNSGTTKPENGNASKPFKIFIGYDPREDVAYEVCRHSLLKRSSIPIEIHPIKQSELRQKSLYWRERGKLESTEFSFSRFLTPYLANYEGWAMFVDCDFLYLGDIKELRDLIDDKYAVMCVQHDYAPKETTKMDGAVQTVYPRKNWSSMVLYNCGHPKNKVLTPEVVNSESGAFLHRFTWLEDHEIGDVPFVWNFLVGHNRVVEGNPSTLPKAIHYTLGGPWFEAWKDCDFADLWLKELEEYKKTEKVD

SEQ ID NO: 4919 - protein, 253 aa, Nicotiana tabacum
  misc_feature (46)..(46): Xaa can be any naturally occurring amino acid
  misc_feature (59)..(59): Xaa can be any naturally occurring amino acid
  misc_feature (66)..(66): Xaa can be any naturally occurring amino acid
  misc_feature (168)..(168): Xaa can be any naturally occurring amino acid
  misc_feature (195)..(195): Xaa can be any naturally occurring amino acid
MSTMVKDVYSNGNVNSENDPNSKPFKIFIGYDPSEDVAYEVCKYSXLKRSSIPIEIIPXKQSELRXKGLYWRERGKLESTEFSFSRFLTPHLANYEGWAMFVDCDFLYLGDIKELRDMVDDKYAVMCVHHDYAPKETTKMDGAVQTVYPRKNWSSMVLYNCGHPKNKXLTPEIVNTESGAFLHRFMWLEDNEIGXVPFVWNFLVGHNKVVEGDPNTFPKSIHYTLGGPWFEAWKDCEFGDLWIKELEEYKKVD

SEQ ID NO: 4920 - protein, 254 aa, Solanum phureja
MSSVVKDLHSNVEKSETPLKPFKIFVGYDPREDVAYEVCRYSLLKRSSIPLEITPIKQCELREQGLYWRERGKLESTEFSFSRFLTPYLADYEGWAMFVDCDFLYLGDIKELRDMVDDKYALMCVQHDYTPKETTKMDGAVQTVYPRKNWSSMVLYNCGHPKNRGLTPEVVNSESGAFLHRFMWLEDEEIGEVPFVWNFLVGHNKVVEGDPATFPKAIHYTLGGPWFEAWKDCEFGELWLKEMEESKKAEEKVV

SEQ ID NO: 4921 - protein, 249 aa, Tabernaemontana elegans
MNSNGHVAESNGSAKPFKIFIGYDPREDVAYEVCRYSLLKRSSIPIEITPIKQSELREKSLYWRERGKLESTEFSFSRFLTPHLANYEGWAMFVDCDFLYLGDIKELTNLIDDKYAVMCVQHDYTPKETTKMDGAVQTVYPRKNWSSMVLYNCGHPKNKVLKPEVVNTESGAFLHRFQWLDDKEIGEIPFVWNFLVGHNKVVEGDPSTLPKAIHYTLGGPWFEQWKDCEFGDLWLKELDEYKNAMQKAN

SEQ ID NO: 4922 - protein, 266 aa, Solanum melongena
MSSVVKDLDANGVDVMKSETPFSNGTNSKPFKIFIGYDPREDVAYEVCRYSLLKRSSIPLETTPIKLSELRQQGMYWRERGKLESTEFSFSRFLTPYLADYEGWAMFVDCDFLFLGDIKELRDMVDDKYALMCVQHDYTPKETTKMDGAVQTVYPRKNWSSMVLYNCGHPKNRALTPEVVNSESGAFLHRFMWLEDGEIGEVPFVWNFLVGHNKVVESDPATFPKAIHYTLGGPWFEAWKDCEFGDLWLKELEECKKTKEKVVKTI

SEQ ID NO: 4923 - protein, 283 aa, Coffea canephora
MSTLVAETNFKNEEVKKSLSPTKAGLDSLPKSLVNGNANKDNADKPPKLKIFIGYDPREDIAYEVCRYSLLKRSSIPVEITPIKQSELRGKGLYWRERGKLESTEFSFSRFLTPHLADYEGWAMFVDCDFLYLGDIKELTDLIDDRFAIMCVQHDYAPKETTKMDGAVQTVYPRKNWSSMVLYNCSHPKNRILTPEVVNTESGAFLHRFQWLEDDEIGEIPFVWNFLVGHNRVVEGDSSTFPKAIHYTLGGPWFEAWKDCEFGDLWLKELEEYKKAKEKKVDS

SEQ ID NO: 4924 - protein, 273 aa, Lippia dulcis
MSGGVDVHRSSNAEVRNPDPISKNLINGNENCQDGNSKPFKVFIGYDPREDLAYEVCRHSLLKRSSIPIEIFPIKQSELREKGLYWRERGKLESTEFSFSRFLTPHLANYEGWAMFVDCDFLYLDDIKKLVDLIDDKYAIMCVQHDYAPKESTKMDGAVQTVYPRKNWSSMVLYNCGHPKNKVLSPEVVNKETGAFLHRFQWLNDDEIGEIPFVWNFLVGHNKVVECDSSTFPKAIHYTLGGPWFEQWKDCEFGDLWLKELEEFQKADVKKEN

SEQ ID NO: 4925 - protein, 256 aa, Amsonia hubrichtii
MSTLVAEMNSNGNAAKSNGDAKPFKIFIGYDPKEDVAYEVCRYSLLKRSSIPIDITPIKQSELREKGLYWRERGKLESTEFSFSRFLTPYLANYEGWAMFVDCDFLYLGDIKELTNLIDDKYAIMCIQHDYTPKETTKMDGAVQTVYPRKNWSSMVLYNCGHPKNKVLKPEVVNSESGAFLHRFQWLEDKEIGEIPFVWNFLVGHNKVVEGDPSTLPKAIHYTLGGPWFEAWKDCEFGDLWLKELEEYKNSMQKAN

SEQ ID NO: 4926 - protein, 270 aa, Solanum phureja
MRGNDPNPFDEEEPEVNPFSKGGSAPASKSRFPQMIASTLGFGQKHDATVDVPLDSMNGSNKKQKELATWEADLQRRERDIKRREDAVAGAGVPTDDRNWPPFFPIIHHDIANEIPAHSQRLQYLAFASWLGIVFCLAFNVLAVTICWIKGGGVKIFFLAIIYALMGCPLSYILWYRPLYNAMRTDSALKFGWFFMFYLVHIGFCILAAIAPPIVFQGKSLTGILSAIDVFSDHVLVGIFYLIGFGFFCLEGLLSLWVLQKVYMYFRGNK

SEQ ID NO: 4927 - protein, 270 aa, Solanum melongena
MRGNDPNPFDEEEPEVNPFSKGGSDPASKSRFPQMIASTLGFGQKHDATVDVPLDSVNGPNKKQKELAAWEADLQRRERDIKRREDAVAGAGVQIDDRNWPPFFPIIHHDIANEIPAHSQRLQYLAFASWLGIVFCLAFNVLAVTICWIKDGGVKIFFLAVIYALTGWPLSYVLWYRPLYNAMRTDSALKFGWFFLFYLFHIGFCILAAIAPPIVFQGRSLTGILAAIDVFSDHVLVGIFYLIGFGFFCLEVLLSLWVLQKVYMYFRGHK

SEQ ID NO: 4928 - protein, 270 aa, Capsicum annuum
MSRNDPNPFDEEEPEVNPFSKGGSAPASKSRFPQVIANTLGFGQKHDATVDIPLDSMNGPNQKQKELATWEADLQRRERDIKRREDAVAGAGVPTDDRNWPPFFPIIHHDIANEIPAHSQRLQYLAFASWLGIVFCLVFNVLAVTIYWIKGGGVKIFFLAVIYALTGCPLSYVLWYRPLYNAMRTDSALKFGWFFLFYLLHIGFCILAAIAPPIVFHGKSLTGILAAIDVFSDIVLAGIFYLIGFGLFCLEVLLSLWVLQKVYMYFRGHK

SEQ ID NO: 4929 - protein, 271 aa, Coffea canephora
MNRSSDPNPFDEEEQEVNPFSKGNAAPGSKSRVPQFVSNTLGFGQKHDATVDIPLDSMNDSKKKQKELADWEADIKRRERDIKRREDAVASAGVPADDRNWPPFFPIIHHDIANEIPVHAQRLQYLAFASWLGIVLCLVFNVIAVTVCWIRGGGVKIFFLSIIYALLGCPLSYVLWYRPLYRAMRTDSAFKFGWFFLCYLIHIGFCILAAIAPPIVFHGRSLTGILAAIDVFSDHVLVGIFYLVGFGLFCLESLLSLWVVQKVYMYFRGHK

SEQ ID NO: 4930 - protein, 278 aa, Lippia dulcis
MNRGHDPNPFDEGEPEVNPFANGAGSKSRVPKVVANTFGFGQKHDATVDIPLDSMNGSKKKEKELATWEADLNRREREIKRRENAVSSAGVPVDDRNWPPFFPIIHHDIANEIPAHAQRLQYLAFASWLGILLCLVFNVIAITICWIKGGGVKIFFLAIIYALMGCPLSYVLWYRPLYRAVRTDSALKFGWFFLFYMLHIGFCILAAIAPPIVFHGQSLTGILAAIDVFSDHVLVGIFLPGRVCILLLGITAELVGTPESLYVLQGTQVILEVSGLSF

SEQ ID NO: 4931 - protein, 271 aa, Amsonia hubrichtii
MHRRDDPNPFDEEQQEVNPFGNGGAAPASKSRFPQMVASTLGFGQKHDATVDIPLDSKNDPKKKEKELADWEADLKRMERDIKRREEAVAGAGVPTDDRNWPPFFPIIHHDIANEIPAHAQRLQYLAFASWLGIVLCLVFNVVAVTTCWIRNGGVKIFFLAIIYALLGVPLSYVLWYRPLYRAMRTDSALKFSWFFMFYLLHIAFCIFAAIAPPVVFHGKSLTGILAAIDVFSDHVVVGIFYMVGFGLFCLESLLSLWVLQKVYMYFRGHK

SEQ ID NO: 4932 - protein, 267 aa, Mimulus guttatus
MNRGNDPNPFDDEEPEVNPFSQGAGKSRMPNVVASTLGFGRKHDATVDIPLDNMNDSRKKEKELSTWEADLDRRERDIKRREAAVASAGVPVDDKNWPPFFPLIHHDIANEIPVHAQRLQYFAFASWLGIVLCLVFNVIAVTICWIRGGGVKIFFLAIIYALMGVPLSYVLWYRPLYRAVRTDSALKFGWFFLFYLIHIGFCILAAIAPPIVFQGRSLTGILAAIDVFSDHVLVGIFYLLGFGFFCLESLLSLWVLQKVYAYFRGNK

SEQ ID NO: 4933 - protein, 271 aa, Tabernaemontana elegans
MNRRDDPNPFDEEQPEVNPFANGGAAPASKSRFPQMVASTLGFGQKHDATVDIPLDSMNDPKKKERDLANWEADLKRRERDIKRREEAVAGAGVPTDDRNWPPFFPIIHHDIANEIPAHAQRLQYLAFASWLGIVLCLVFNIVAVTACWIRNGGVKIFFLAIIYALLGVPLSYVLWYRPLYRAMRTDSALKFGWFFMFYLLHIAFCIFAAIAPPVVFHGKSLTGILAAIDVFSDHVVVGIFYIVGFGLFCLESVLSLWVLQKVYMFFRGHK

SEQ ID NO: 4934 - protein, 268 aa, Sesamum indicum
MSRGNDPNPFDEEEPEVNPFSNGGGSKSRIPKVVANTLGFGQKHDATVDIPLDAMNDPKKKQKELAAWEADLNRREREIKRREDAVVSAGVPVDDRNWPPFFPIIHHDIANEIPVHAQKLQYLAFASWLGIVLCLVFNVIAITVCWIRGGGVKIFFLAIIYALMGCPLSYVLWYRPLYRAMRTDSALKFGWFFLFYMLHIGFCIVAAIAPPIVFHGKSLTGILAAIDVFSDHVLVGIFYLIGFAFFCLESLLSLWVLQKVYAFFRGNK

SEQ ID NO: 4935 - protein, 172 aa, Vaccinium corymbosum
MNDGNKKQKELATWEADLKRREREIKRREDAVASAGVPVDDRNWPPFFPIIHHDIANEIPVHAQRLQYLAFASWLGIVLCLVFNVVAVTVCWIRGGGVKIFFLATIYALLGCPLSYVLWYRPLYRAMRTDSALKFGWFFLFYMLHLIFCIFAAIAPPIVFLRAVIDGNSCCS

SEQ ID NO: 4936 - protein, 269 aa, Actinidia deliciosa
  misc_feature (190)..(190): Xaa can be any naturally occurring amino acid
MNSRNDPNPFDEEEVNPFSKGNSAPGSKSRIPQMVAQTLGFGQKHDATVDIPLDTMNDGKNKEKELAAWEADLKRRERDIKRREDAVASAGVPSDDRNWPPFFPIIHHDIANEIPVHAQKLQYLAFASWLGIVLCLVFNVVAVTVCWIRGGGVKIFFLAIIYALLGCPLSYVLWYRPLYRAMRTDSALKXGWFFMFYLIHIGFCIFAAIAPPIVFHGKSFTGILAAVDVFADHVLVGIFYLIGFALFCLESLLSLWVLQKIYLYFRGNK

SEQ ID NO: 4937 - protein, 270 aa, Salvia sclarea
MNRGNDPNPFDEEEPEVNPFANGGKSKSRIPKVVASTLGFGQKHDATVDIPLDTSTANDSKKKERELASWEADLNKRERDIKRREDAVTSAGVPVDDRNWPPFFPIIHHDIANEIPVHAQKLQYLAFASWLGIVICLVFNVIAITICWIRGGGVKIFFLAIIYALMGCPMSYVLWYRPLYRAMRTDSALKFGWFFMFYMIHIGFCILAAIAPPIVFHGQSLTGILAAVDVFSDHVLVGIFYLIGFAFFCLESLLSLWVLQKVYTYFRGQK

SEQ ID NO: 4938 - protein, 269 aa, Valeriana officinalis
MNRRDDPNPFDEEEVNPFANGKAAPASKSRIPQMVASSLGFGQKHDATTDIPLDSMNDPKKKERELSDWEADLKRRERDIKRREDAVSNAGIPADDRNWPPFFPIIHHDIANEIPVHAQRLQYLAFASWLGIVLCLVFNVVAVTVCWIRGGGVRIFFLAIIYALTGCPLSYVLWYRPLYRAMRTDSALKFSWFFLFYLLHIGFCIIAAIAPPIVFRGKSFTGILSAIDVFSDHVLVGIFYLIGFGFFCLETLLSIWVLQKVYMFFRGHK

SEQ ID NO: 4939 - protein, 271 aa, Catharanthus roseus
MNRRDDPNPFDEEQPEVNPFANGGAAPASKSRFPQMVASTLGFGQKHDATVDIPLDSMNDSKKKERELADWEADLRRRERDIKRREEAVAGAGIPTDDRNWPPFFPIIHHDIPNEIPAHAQRLQYLAFASWLGIVLCLVFNVGAVTACWIRNGGVKIFFLAIIYALLGVPLSYVLWYRPLYRAMRTDSALKFSWFFIFYMLHIAFCIFAAIAPPVVFHGKSLTGILAAIDVISDHVVVGIIYMVGFGLFCLESLLSLWVLQKVYVFFRGHK

SEQ ID NO: 4940 - protein, 271 aa, Ipomoea nil
MNRRNDPNPFDEEEQEVNPFSNGSTAAGSKSRIPQMVANTLGFGQKHDATVDIPLDSMNDPKKKERELANWEADLKRRERDIKRREDAVTSAGVPVNDKNWPPFLPIIHHDIANEIPAHSQRMQYLAFASWLGIVLCLTFNIIAVIVCWIKGGGVKIFFLAVIYALLGCPLSYVLWYRPLYNAMRTDSALKFGWFFLFYMLHIGFCIFAAIAPPVVFHGKSLTGILAAIDVFSDHVLVGIFYLVGFGLFCLESLLSLSVLQRVYMHFRGNK

SEQ ID NO: 4941 - protein, 271 aa, Vinca minor
MNRRDDPNPFDEEQPEVNPFANGGAAPAAKSRFPQMVASTLGFGQKHDATVDIPLDSMNDPKKKEKELANWEADLKRRERDIKRREEAVAGAGVPTDDRNWPPFFPLIHHDIANEIPAHAQKLQYLAFASWLGIVLCLVFNIVAVTTCWIKNGGVTIFLLAIIYAFLGVPLSYVLWYRPLYRAMRTDSALKFSWFFMFYLLHIAFCIFAAIAPPVVFRGKSLAGILPAIDVFSDHVLVGIFYLVGFGLFCLESLLSMWVLQKVYMFFRGNK

SEQ ID NO: 4942 - protein, 269 aa, Sarracenia psittacina
MNSRNDPNPFDEEEVNPFSNGTAGPGSKSRIPQMVAQTLGFGQKHDATVDIPLDTMNDTRKKDKDLAAWEADLKRREREIKRREDAVASAGVPSDDKNWPPFFPIIHHDIANEIPIHAQKLQYLAFASWLGIVLCLVFNVVAVTVCWIRGEGVKIFFLATIYAILGCPLSYVLWYRPLYRAMRTDSALKFSWFFLFYLIHIGFCIFAAIAPPIVFHGKSLTGILAAIDVFSDHVLVGIFYLVGFALFCLESLLSLWVLQKVYMYFRGNK

SEQ ID NO: 4943 - protein, 269 aa, Eucalyptus grandis
MNRHHDPNPFDEEEEVNPFSKGTAPASKSRLPPLASEPLGFGQKHDATVDIPLDTMNDSKEKVKELASWEADLKRREREIKRREDAVSKANVPLDDKNWPPCFPIIHHDIANEIPVHAQRLQYLAFASWLGIVLCLTFNVLAVTVCWIRGGGVKIFFLAIIYALMGCPLSYVLWYRPLYRAMRTDSALNFSWFFLFYLLHVGFCIFAAIAPPIVFHGKSLTGILAAIDVFSDHVLVGIFYLVGFALFCLESLLSMWVLQKTYMYFRGHK

SEQ ID NO: 4944 - protein, 268 aa, Plantago ovata
MNRRNDPNPFDEEEPEVNPFANGGGSKSRIPQAVASTFGFGQKHDATVDIPLDNMNDSRKKEKELSNWEADLSRREREIKRREDAVANANVPVDDRNWPPFFPIIHHDIANEIPVHAQRLQYLAFASWLGIVLCLVFNVIAITVCWIRGGGVRIFFLAIIYALMGCPISYVLWYRPLYRAMRTESALNFGWFFLFYMIHIGFCILAAIAPPIVFQGRSLTGILAAIDVFSDHILVGIFYLVGFGLFCVETLLSIWVLQKVYAYFRGNK

SEQ ID NO: 4945 - protein, 269 aa, Carthamus tinctorius
MNHREDPNPFDDEEVNPFSNGNAAPGSKSRIPQMVASTFGFGQKHDATVDIPLDSMNDPKKKEKELSNWEADLKRRERDIKRREEAVAGAGIPTDDRNWPPFFPIIHHDISNEIPVHAQKLQYLAFASWLGIVLCLTFNAVAVTVCWIKGGGVKIFFLATIYALLGVPLSYVLWYRPLYRAMRTDSAFKFGWFFMFYLLHLGFCIFAAIAPPIVFHGKSLTGILAAVDVFSDHVLVGIFYLVGFGLFCLESLLSFWVLQKVYMFFRGNK

SEQ ID NO: 4946 - protein, 268 aa, Cirsium arvense
MNHRDDPNPFDEEVNPFSNGGAAPGSKSRIPQMVASTLGFGQKHDATVDIPLDSMNDPKKKEKELSNWEADLKRRERDIKRREEAVTGAGIPTDDRNWPPFFPIIHHDISNEIPVHAQKLQYLAFASWLGIVLCLTFNVVAVTVCWIKGGGVKIFFLATIYALLGVPLSYVLWYRPLYRAMRTDSAFKFGWFFMFYLLHLGFCIFAAIAPPIVFHGQSLTGILAAVDVFSDHILVGIFYLVGFGLFCLESLLSFWVIQKVYVFFRGNK

SEQ ID NO: 4947 - protein, 268 aa, Cirsium arvense
MNRREDPNPFDEEVNPFSNGDAAPGSKSRIPQMVASTLGFGQKHDATVDIPLDSMNDPKKKEKELTNWEADLKRREKDIKRREEVVAGAAIPTDDRNWPPFFPIIHHDIANEIPVHAQKLQYLAFASWLGLVLCLVFNVIAVIVCWIKGGGVKIFFLATIYALLGVPLSYVLWYRPLYRAMRTDSALKFGGFFLFYLLHLGFCIFAAIAPPIVFHGKSLTGILAAIDVFSDHALAGIFYLVGFGFFCLESLLSFWVLQKVYTYFRGNK

SEQ ID NO: 4948 - protein, 269 aa, Cucumis melo
MNRHNDPNPFDEEEVNPFSKGGGAPGSKFRIPQMVSDTLGFGQKHDATVDIPLDTMNDPKKKERELAAWEAELNRKEKEIKKREEAVSKAGVPADDRNWPPFFPIIHHDIANEIPVHAQKLQYLAFASWLGIVLCLFFNVIAITVCWIRGGGVKIFFLAVIYAILGIPLSYVLWYRPLYRAMRTDSALKFGWFFMFYLLHIAFCIFAAIAPPVVFHGQSLTGILAAIDVFSDHVLVGIFYLIGFGFFCLESLLSLWVLQKIYLYFRGNK

SEQ ID NO: 4949 - protein, 269 aa, Glycine max
MNRHHDPNPFEEEEVNPFSNGTTAPASKSRIPPLASESLGFGQRHDATVDIPLDTTNDSKKKGQELAAWEADLKRREKEIKRREEAVSRAGVPVDDKNWPPFFPIIHHDIANEIPVHAQRLQYLAFASWLGIVLCLGFNVVAVTVCWIRGGGVKIFFLAVIYALLGVPLSYVLWYRPLYRAMRTDSALKFGWFFMLYLLHIGFCIFAAIAPPIVFHGKSLTGILAAIDVFSDHVLVGIFYLIGFGMFCLEALLSFWVLQKIYMYFRGHK

SEQ ID NO: 4950 - protein, 269 aa, Glycine max
MNRHNDPNPFEEEEVNPFSNGGAAPASKSRIPPLASQPLGFGQRHDATVDIPLDTTNDSKKRGQELAAWEADLKRKEKEIKRREEAVSRAGVPVDDKNWPPIFPIIHHDIANEIPVHAQRLQYLAFASWLGIVLCLVFNVVAVTVCWIRGGGVKIFFLAVIYGLLGVPLSYVLWYRPLYRAMRTDSALKFGWFFMFYLLHIGFCIFAAIAPPIVFHGKSLTGILAAIDVFSDHVLVGIFYLIGFGMFCLEALLSLWVLQKIYMYFRGHK

SEQ ID NO: 4951 - protein, 1239 aa, Solanum lycopersicum
MYPTNPYQRNQVPYNPHYYPRFESNPHHHMNIDPTRSTLPYESWPCGGSNYRHPYPPECHSCCIHNTSPSQCAFSPPYPYLPPSTYPVMYPTHYVPHPHFTMEQPRYEYEKNMGRDHHCCGCSNHKCGSKKGGSSVKIEEHDQDKGNDCNDSLVPFGFNNCPYPVVCLPPDDMKNRERMKPDGSNCKEQEENPQPLKPLGDFRPSQQPNFWKLWPSHYGNSSGSPKENGDFPEKQHHDDAIRKQFPFPIIWMPYRPEEDREEVGKETESGLIAEKEPTSPSKLTKLMSHDSEDKRSSSKENEVNSGGDFHGKGLNKGSVVKTIPVKQVEQNEIFDGKKEEASQRHESDAKQKKITQEAGRKQSTSPTKSSKLPPVCLRVDPLPRKKSSSGNSRSPSPPRGKGKLVESRSDSSKPPIKSNEKENVQLDKSSTTSMPRKSTEVEPSKSKAKVVEVAQGTAKEDILHDQCTVFPDLKRQARSKIAEGDTGKAANKPKDELDAVVAKAQSSNEAHQRGEARQAVNEEVDAGNKTKREKRSKMSNDEAATKIQSAYRGFTLRRWEPLKKLKQLAKIEEQMAEHKRHIQTLESSADNGVDNKQRTFLTEVIMGLLLKLDTIQGLHPTVREYRKSVAKELVSLQEKLDLLNCKKQPAESEQTVTAKSSEDTSMAVEDNPSLQGGQEVQKLERDDDFVKGDEGIKFDAKGLCEEQTLCATELLANSHDVGNAVLEGKELNKDVEEVMEGVLGSSAVKTGDGASVQHFESEEKTDKLFDENTAVVEKLEERGDGVDELEELPRGVLDEETSIKGSAEIRKDTVDLTALTLDEKVSDTASLEHHHLEALGETPFILGTENMHSSNGVEENAEILERDAAVPIDIPKREKEDAKPLSEDANISDVDDKVGMEKNEKELDQGGSASDGFSIPSQEDAITTEQPTDTTNAEESETVEVLQEKMQNAVDKDIEILDSGKPVEKSVEPQLSTGTNDEAREYHIQDKQKIGEENKEVQGEELPVRDDAVVSEPNNEGKERNVVVEQRLVEESFEMQGNEPVAAEPETADNAAHVIEEPVDGTKATAAPASEAVTTETDLSREKELGVADDHNTHRSCDAVEGNSVDTSHSFGSSTPIEVQVMDANKLKEWMKVDMSPSSPTASQESCDSDALSESDKKLIEENEKLREMMEKLIKSGNEQLTAISSLYGRVKDLEKRLSKKKKLKLKRNRVPAAGSACVKPLNDSLRNRSVGLAM

SEQ ID NO: 4952 - protein, 1239 aa, Solanum phureja
MYPMNPYQRNQVPYNPHYYPHFESNPHHHMNIDPTRSTLPYESWPCGGSSYGHPYPPQCHSCCIHNNSPSQCAFSPPYPYLPPPTYPVMYPTHYVPPPHFSMEQPRYEYEKNMGRDHHCCGCSNHQCGSKKGGGSSVKIEEHGQDKKNESNESLVPFGFKNCPYPVVSLPPDDMKNREHMKPNGSNCKEEEENPQVVKPFGDFRPFQQPNVWNLWPSHYGNSSESPKQTGDLPGKQQDDDSIRKQFPFPIIWMPYKPEEDGERVGKETESGLIAEKEPTSPSKLTKPMLHDSEDKRSSSKENEVISGSEIRGKGLNKGTVVKIIPVKQVEQNEIFDGKKEEASERHESDAKQKKIAQEGGKKQSPSPTKSSKLPPVCLRVDPLPRKKSSNGNSRSPSPPCGKGKLVESRSESSKPPIQSNEKENVQLDKSSTTSMPKKSTEVEPSKGKTKVVEVAQGTSKEDKLQDQCTVFSDLKRQARSQTGEGDTSKAANKPKDEPDAVAAKAQSSNEGHHRGEAREAANVDVGAGNEMKRVKRSQLSDDKAATMIQSVYRGFNVRRWEPLKKLKQIAKIEEQMAEIKKRIQDLESSADNGVDNKQRTIITEIIMSLLLKLDAIQGLHPAVREYRKSVAKEIVSLQEKLDLLNCKKQPAESEETFTAKSSEDTCTAVEDNPSLQGQEVQKLERDDDFTKGDEGIKFDAEGLCEEQPLCATEMLPDSHDVGNAVLEGKEENKDVEEVMEGVSGSSAVKTGDGASVKPFESEEKTDKLLDENTAVVEKLEERGDGVDELEELPRGVLDEETSIKGSAEIRKDTVDLTALTLDEKVSDTASLEHHHLEALGETPFILGTENMHSSNGVEENAEILERDAAVPIDIPKREKEDAKPLSEDANISDVDDKVGMEKNEKELDQGGSASDGFSIPSQEDAITTEQPTDTTNAEESETVEVLQEKMQNAVDKDIEILDSGKPVEKSVEPQLSTGTNDEAREYHIQDKQKIGEENKEVQGEELPVRDDAVVSEPNNEGKERNVVVEQRLVEESFEMQGNEPVAAEPETADNAAHVIEEPVDGTKATAAPASEAVTTETDLSREKELGVADDHNTHRSCDAVEGNSVDTSHSFGSSTPIEVQVMDANKLKEWMKVDMSPSSPTASQESCDSDALSESDKKLIEENEKLREMMEKLIKSGNEQLTAISSLYGRVKDLEKRLSKKKKLKLKRNRVPAAGSACVKPLNDSLRNRSVGLAM

SEQ ID NO: 4953 - protein, 1239 aa, Solanum tuberosum
MYPMNPYQRNQVPYNPHYYPHFESNPHHHMNIDPTRSTLPYESWPCGGSSYGHPYPPQCHSCCIHNNSPSQCAFSPPYPYLPPPTYPVMYPTHYVPPPHFSMEQPRYEYEKNMGRDHHCCGCSNHQCGSKKGGGSSVKIEEHGQDKKNESNESLVPFGFKNCPYPVVSLPPDDMKNREHMKPNGSNCKEEEENPQVVKPFGDFRPFQQPNVWNLWPSHYGNSSESPKQTGDLPGKQQDDDSIRKQFPFPIIWMPYKPEEDGERVGKETESGLIAEKEPTSPSKLTKPMLHDSEDKRSSSKENEVISGSEIRGKGLNKGTVVKIIPVKQVEQNEIFDRKKEEASERHESDAKQKKIAQEGGKKQSPSPTKSSKLPPVCLRVDPLPRKKSSNGNSRSPSPPCGKGKLVESRSESSKPPIQSNEKENVQLDKSSTTSMPKKSTEVEPSKGKTKVVEVAQGTSKEDKLQDQCTVFSDLKRQARSQTGEGDTSKAANKPKDEPDAVAAKAQSSNEGHHRGEAREAANVDVGAGNEMKRVKRSQLSDDKAATMIQSVYRGFNVRRWEPLKKLKQIAKIEEQMAEIKKRIQDLESSADNGVDNKQRTIITEIITSLLLKLDAIQGLHPAVREYRKSVAKELVSLQEKLDLLNCKKQPAESEETFTAKSSEDTCTAVEDNPSLQGQEVQKLERDDDFTKGDEGIKFDAEGLCEEQPLCATEMLPDSHDVGNAVLEGKEENKDVEEVMEGVSGSSAVKTGDGASVKPFESEEKTDKLLDENTAVVEKLEERGDGVDELEELPRGVLDEETSIKGSAEIRKDTVDLTALTLDEKVSDTASLEHHHLEALGETPFILGTENMHSSNGVEENAEILERDAAVPIDIPKREKEDAKPLSEDANISDVDDKVGMEKNEKELDQGGSASDGFSIPSQADAITTEQPTDTTNAEESETVEVLQEKMQNAVDKDIEILDSGKPVEKSVEPQLSTGTNDEAQEYHIQDKQKIGEENKEVQGEELPVCDDAVVSEPNNEGKERNVVVEQRLVEESFEMQGNEPAAAEPETADNAAHVIEEPVDGSKATAAPASEAVTTETDLSREKELGVADDHNTHRSCDAVEGNSVDTSHSFGSSTPIEVQVMDANKLKEWMKVDMSPSSPTASQESCDSDALSESDKKLIEENEKLREMMEKLIKSGNEQLTAISSLYGRVKDLEKRLSKKKKLKLKRNRVPAAGSACVKPLNDSLRNRSVGLAM

SEQ ID NO: 4954 - protein, 563 aa, Solanum phureja
MGTLQTWRKAYGALKDHTTVGLAHVNSDFKDVDVAIVKATNHVECPPKDRHLRKILVYTSAMRPRADVAYCIHALARRLAKTHNWTVALKTLIVIHRTLREGDPTFREELLNFQQRGHVLQMSNFKDDSSPIAWDCSAWVRTYALFLEERLECFRVLKYDIEGERLPKPAQGQEKGYSRTRELPSEELLEQLPALQQLLYRLIGCRPEGVALGNYVIQYALALVLKESFKIYCAINDGIINLIDKFFDMPRHEAIKALDIYKRAGQQAMNLSDFYGVCKGLELARNFQFPVLREPPQSFLVTMEEYIKEAPRIVSVPIETLDYPERLMLTYKQEDEPSASEDAQDSANETPPPLPLDDAVVSTTETPSPPMPPPPSSLESDDLLGLNAPTGYASAIEDSNALALAIVPSGTTPFDSNPAQPKDFDPTGWELALVTTPSSDLSAAQERQLAGGMDSLTLNSLYDEGAYRASQRPVYGAPAPNPFEVADPFAMSTTMAPPPSVQMAAVPQHQMNPFGPFEPAYPQPQNPMMNPHNPFGDAGFSAFPTNHVAHPQTTNPFGSTGLI

SEQ ID NO: 4955 - protein, 562 aa, Sesamum indicum
TLQTWRKAYGALKDHTRVGLAHVNSDFKDVDVAIVKATNHVECPPKERHLRKILVATSAMRPRADVAYCIHALARRLAKTHNWTVALKTLIVIHRALREGDPTFREELLNFQQRGRVLQMSNFKDDSSPIAWDCSAWVRTYALFLEERLECFRILKYDIEAERLPRPAQGQDKGYSRTRDLDSEELLDQLPALQQLLYRLIGCRPEGAAVGNYVIQYALALVLKESFKIYCAINDGIINLVDKFFEMPRHEAIKALDIYKRAGQQANSLSDFYEVCKGLELARNFQFPVLREPPQSFLVTMEEYIREAPRMVSVPSVALEYPERLMLTYKEEDVPPPSEETKIVSEEPSPPQSDEVAISTAETAPPVPPPPTNLDTDDLLGLNVTTQDASAIEETNALALAIVPSGTTPFDSDAPQVKDFDPTGWELALVTTPSTNLSSVQERQLAGGLDSLTLNSLYDEGAYRASQQPVYGAPAPNPFEVSDPFAISNNVPPPPTVQMAAMTQPQNNPFAPFQPAYPPPQQQQHLLMSPQNPFGDAGFGAFPAAPAAHPQTTNPFGSTSLL

SEQ ID NO: 4956 - protein, 337 aa, Solanum phureja
MAPNVFGLATKATGLAKAKSLPSRAYVTFLAGNGDYWKGVVGLVKGLRKAKSAYPLVVACLPDVPEEHRRILINQGCIVREIEPVYPPENQTQFAMAYYVINYSKLRIWEFVEYSKMIYLDGDIQVFDNIDHLFDLPDGYFYAVMDCFCEKTWSHTPQYKVGYCQQCPDKVQWTQDLGPKPSLYFNAGMFVYEPNLSTYDDLLKTVKVTPPTPFAEQDFLNMYFRDVYKPIPNNYNLVLAMLWRHPENVDLEKVKVVHYCAAGSKPWRYTGKEENMDREDIKMLIKKWWDIYDDVSLDYKNSNVVMTAVDGEVEAEKFMAALSEAGVVHYITAPSAA

SEQ ID NO: 4957 - protein, 336 aa, Solanum tuberosum
MAPNVFGLATKATGLAKAKSLPSRAYVTFLAGNGDYWKGVVGLVKGLRKAKSAYPLVVACLPDVPEEHRRILINQGCIVREIEPVYPPENQTQFAMAYYVINYSKLRIWEFVEYSKMIYLDGDIQVFDNIDHLFDLPDGYFYAVMDCFCEKTWSHTPQYKVGYCQQCPDKVQWTQDLGPKPSLYFNAGMFVYEPNLSTYDDLLKTVKVTPPTPFAEQDFLNMYFRDVYKPIPNHYNLVLAMLWRHPENVDLEKVKVVHYCAAGSKPWRYTGKEENMDREDIKMLIKKWWDIYDDVSLDYKNSNVVTAIDGEVEAEKFMAALSEAGAVNYITAPSAA

SEQ ID NO: 4958 - protein, 336 aa, Capsicum annuum
MAPNVFGLANKATGLAKTKSLSSRAYVTFLAGNGDYWQGVVGLVKGLRKAKSAYPLVVACLPDVPEEHRRILINQGCIVREIEPVYPPENQTQFAMAYYVINYSKLRIWEFVEYSKMIYLDGDIQVFDNIDHLFDLPDGYFYAVMDCFCEKTWSHTPQYKVGYCQQCPDKVQWTQDLGPKPSLYFNAGMFVYEPSLSTYDDLLKTLKVTPPTPFAEQDFLNMYFRDVYKPIPNNYNLVLAMLWRHPENVDLDKVKVVHYCAAGSKPWRYTGKEENMDREDIKMLIKKWWDIYNDITLDYKNANVTPVVDDQVEANKLMTAISEPDVLHYITAPSAA

SEQ ID NO: 4959 - protein, 337 aa, Petunia hybrida
MAPTVVNGLARKASTGLAKAASLSSRAYVTFLAGNGDYVKGVVGLAKGLRKAKSAYPLVVAILPDVPEEHRRILVNQGCIVREIEPVYPPENQTQFAMAYYVINYSKLRIWEFVEYSKMIYLDGDIQVFDNIDHLFDLPDGYFYAVMDCFCEKTWSHTPQYKVGYCQQCPDKVQWTEELGPKPPLYFNAGMFVYEPSLSIYDDLLKTLKVTPPTPFAEQDFLNMFFRDVYKPIPNNYNLVLAMLWRHPENVDLNKVKVVHYCAAGSKPWRYTGEEENMDREDIKLLVNKWWDIYNDESLDYKNVNVTAVDDEAEANKFMAALTKGGVVHYITAPSAA

SEQ ID NO: 4960 - protein, 336 aa, Aquilegia formosa
MAPNIISTATKTVGFTKQASIPSRAFVTFLAGNGDYVKGVVGLAKGLRKVKSAYPLVVAILPDVPEEHRRILESQGCIVREIEPVYPPENQTQFAMAYYVINYSKLRIWEFVEYSKMIYLDGDIQVFENIDHLFDLPNGYFYAVMDCFCEKTWSHTPQYKLGYCQQCPNKVQWPAEMGQPPSLYFNAGMFVYEPSLSTYDDLLKQVKTTPPTPFAEQDFLNMFFKDIYKPIPLVYNLVLAMLWRHPENVELEKVKVVHYCAAGSKPWRYTGKEENMDREDIKMLVKKWWDIYDDASLDYKRSVAPSIPETGENLQPFLAALSEAGVVHYVTAPSAA

SEQ ID NO: 4961 - protein, 337 aa, Catharanthus roseus
MAPEIVSSKAGTTGLVKAASLPSRAYVTFLAGNGDYVKGVVGLAKGLRKVKTAYPLVVAVLPDVPEEHRRILVSQGCIVREIEPVYPPENQTQFAMAYYVINYSKLRIWEFVEYSKMIYLDGDIQVYENIDHLFDLADGYFYAVMDCFCEKTWSHTPQYKIGYCQQCPNKVQWPEQELGPKPPLYFNAGMFVFEPSLPTYDDLLATLKITPPTPFAEQDFLNMFFRDIYKPIPNIYNLVLAMLWRHPENVNLEKVKVVHYCAAGSKPWRYTGEELNMDREDIKMLVKKWWDIYNDESLDYKRCINAAVAVAAHEGKAGGLKPVPAGVVKYITAPSAA

SEQ ID NO: 4962 - protein, 335 aa, Tabernaemontana elegans
MAPELVSSAAPTGLVKAASLSSRAYVTFLAGNGDYVKGVVGLAKGLRKARTAYPLVVAVLPDVPEEHRRILVNQGCIVREIEPVYPPENQTQFAMAYYVINYSKLRIWEFVEYSKMIYLDGDIQVFENIDHLFDLPDGNFYAVMDCFCEKSWSHSPQYQIGYCQQCPNKVQWPEELGPKPSLYFNAGMFVFEPSLPTYDDLLSTVKITTPTLFAEQDFLNMFFRDIYKPIPNVYNLVLAMLWRHPENVELEKVKVVHYCAAGSKPWRYTGEEQNMDREDIKMLVKKWWDIYNDETLDYKRHINAGAATNQAETGGMKAVMSKAGVVKYITAPSAA

SEQ ID NO: 4963 - protein, 338 aa, Euonymus alatus
MAPDLSTNTTTNLTKTASISSCAYVTFLAGNGDYVKGVVGLAKGLRKAKSKYPLVVAILPDVPEEHRKILVDQGCIVKEIEPVYPPQNQTQFAMAYYVINYSKLRIWEFVEYSKMIYLDGDIQVFENIDHLFDMQDGYFYAVMDCFCEKTWSHTPQYKIGYCQQCPNKVQWPEELGPKPPLYFNAGMFVYEPSLSLYDDLLKTVKVTPPTPFAEQDFLNMYFRDIYRPIPPIYNLVLAMLWRHPENIELHKVKVVHYCAAGSKPWRFTGKEENMEREDIKMLVKKWEDIYNDESLDYKNVVARGAVEPVDSEQVRLHPFLAALSEAGVVHYKSAPSAA

SEQ ID NO: 4964 - protein, 334 aa, Populus trichocarpa
MAPDITATLANNTNSLVKQASISSCAYVTFLAGDGDYWKGVVGLAKGLRKAKCNYPLVVAILPDVPEEHRKILASQGCIVREIEPVNPPENQTQFAMAYYVINYSKLRIWEFVEYSKMIYLDGDIQVFDSIDHLFDMPDGYFYAAMDCFCEKTWSNSPQYKIGYCQQCPDKVHWPAEMGPKPPLYFNAGMFVYEPNLSTYHDLLETLKVTPPTLFAEQDFLNMFFRDVYKPIPSDYNLVLALLWRHPENINLDKVKVVHYCAAGSKPWRYTGKEDNMDREDIKMLVNKWWDIYHDESLDYKNTVVAAAGAELQPFLAALSEAGIAHYITAPSAA

SEQ ID NO: 4965 - protein, 336 aa, Populus trichocarpa
MAPELVQAALKPAGFTKPASLPSRAYVTFLAGNGDYVKGVVGLAKGLRKVKTAYPLIVAVLPDVPEEHRRILESQGCIVREIEPVYPPENQTQFAMAYYVINYSKLRIWEFVEYSKMIYLDGDIQVYDNIDHLFDLPDGHFYAVMDCFCEKTWSHTPQYKIGYCQQCPDKVNWPAEMGQPPSLYFNAGMFVFEPSISTYHDLLKTLKVTPPTPFAEQDFLNMYFKDIYKPIPLVYNLVLAMLWRHPENVELDKVKVVHYCAAGSKPWRYTGKEENMQREDIKMLVEKWWGIYNDESLDYMKFVADGFDAEPVNLQSFIAALSEAGAVQYVTAPSAA

SEQ ID NO: 4966 - protein, 337 aa, Populus trichocarpa
MAPHITTTLANTTSSLVKQASLSSCAYVTFLAGDGDYWKGVVGLAKGLRKAKSKYPLVVAILPDVPEEHRMILVSQGCIVREIEPVHPPENQTRFAMPYYVINYSKLRIWEFVEYSKMIYLDGDIQVFDNIDHLFDMPDGYFYAVMDCFCEKTWSNSPQYKIGYCQQCPDKVQWPAEMGPKPPLYFNAGMFVYEPNLSTYHDLLETVKVTSPTLFAEQDFLNMFFRDVYKPIPSDYNLVLAMLWRHPENINLDKVKVVHYCAAGSKPWRFTGKEENMDREDIKMVVNKWWDIYQDESLDYKNTVAAAAASAGAELHPFLAALSEAGVVHYVTAPSAA

SEQ ID NO: 4967 - protein, 277 aa, Capsicum annuum
MAPNVFGLANKATGLAKTKSLSSRAYVTFLAGNGDYWQGVVGLVKGLRKAKSAYPLVVACLPDVPEEHRRILINQGCIVREIEPVYPPENQTQFAMAYYVINYSKLRIWEFVEYSKMIYLDGDIQVFDNIDHLFDLPDGYFYAVMDCFCEKTWSHTPQYKVGYCQQCPDKVQWTQDLGPKPSLYFNAGMFVYEPSLSTYDDLLKTLKVTPPTPFAEQDFLNMYFRDVYKPIPNNYNLVLAMLWRHPENVDLDKVKVVHYCAAGSKPWRYTGKEENMD

SEQ ID NO: 4968 - protein, 188 aa, Solanum phureja
MAISSSSLSAALFPVCNSSSISAQPKFSLLSLPSNSVKLQVFNQSRVSTTKVFASPEVLDAQNVEADVEDIPAASTLSIGGDSDKAAPKQKIRIKLRSYWVPLIEDSCKQIMDAARTTNAKTVGPVPLPTKKRIYCVLKSPHVHKDARFHFEIRTHQRLIDILYPTAQTIDKLMLLDLPAGVDVEVKL

SEQ ID NO: 4969 - protein, 188 aa, Solanum tuberosum
MAISSSSLSAALFPVCNSSSISAQPKFSLLSLPLNSVKLQVFNQSRVSTTKVFASPEVLDAQNVEADVEDIPAASTLSIGGDSDKAAPKQKIRIKLRSYWVPLIEDSCKQIMDAARTTNAKTVGPVPLPTKKRIYCVLKSPHVHKDARFHFEIRTHQRLIDILYPTAQTIDKLMLLDLPAGVDVEVKL

SEQ ID NO: 4970 - protein, 188 aa, Solanum melongena
MAISSSSLAAALFPVCNSSPVSAKPKFSVLSLPSNSVKLQVFSQSRVSKTKIFASPEVLDAQNVDADVEDIPAASTLSAGGDSDKAAPKQKIRIKLRSYWVPLIEDSCKQIMDAARTTNAKLVGPVPLPTKKRIYFVLKSPHVHKDARFHFEIRTHQRLIDILYPTAQTIDKLMLLDLPAGVDVEVKL

SEQ ID NO: 4971 - protein, 188 aa, Capsicum annuum
MAISSSALSTALFPVCNSSSISAKPKISLLSLPSNSTKFQVFNQSRLLTTKVFASPEVLETQDVSDDVENIPAASTLSVDGDADKAAPKQKIRIKLRSYWVPLIEDSCKQIMDAARTTNAKTVGPVPLPTKKRIYCVLKSPHVHKDARFHFEIRTHQRLIDILYPTAQTIDKLMLLDLPAGVDVEVKL

SEQ ID NO: 4972 - protein, 190 aa, Nicotiana tabacum
MAISSSSLSAALFPVCNSSIILSQPKFSVLSLPSNSAKTRIHIFNQSKVSTSKVFASPEVLDAENVSADVEDIPAASTLSVGVDADKAAPKQKIRIKLRSYWVPLIEDSCKQIMDAATTTNAKTVGPVPLPTKKRIYCVLKSPHVHKDARFHFEIRTHQRLIDILYPTAQTIDKLMLLDLPAGVDVEVKL

SEQ ID NO: 4973 - protein, 541 aa, Solanum phureja
MQTIKASSFSPFHLNLNSTSSFPKITNLYIQQNYENPISCFPSIQSQNAKFKVFTAISPSVSTESETPFDERTENENQEEKFEWYAEWYPIMPICDLDKRRPHGKKVMGIDVVVWWDKNEKEWKVMDDSCPHRYAPLSEGRIDQWGRLQCVYHGWCFNGAGDCKFIPQAPRDGPPVHTSKRACATVYPSCVQNDILWFWPNSDPLYKDIYLTKRPPYIPELDDSSFSKTFIVRDISYGYELLIENLMDPAHVQYSHYGIMNNCLCTVKADREGGRPLDITVTKLDVNVITANQGPGRNTFVPPCVYYSYFAFGGPQGKTSAVSSGTVQEKPSAEKQKKALLVFICIPVSPGHSRIIFASPRNFATWADRIIPRWIFHLGQNLILDSDLYLLHVEERKLKEIGSYNWHKACYVPTKADAIVVAFRRWLNKYAGGQVDWRGKYNGDLPPTPPREQLLDRYWTHTVNCTSCNLAYKGLNALEVVLQIASIGVLGIVAAAKQGTLSVVARYSLVTIALLCFVASRWLSHFIYKNFHFHDYDHAFR

SEQ ID NO: 4974 - protein, 348 aa, Solanum phureja
MRSIEDKGCLNYGQKQQEVVGGSSMNFEFHGTNRASTHHRTAALGKPTPSKWDDAQKWLVNLSRGEKHQSKATPRNSNADDLRLIAPVPKKEEYSSDDEGDSSMIQFEVETKKVDCDESIWRVNRNNSASVVRSICVRDMGTEMTPIASQEPSRTATPIRATTPAVRSPISSGSSTPIRGQNGTIENGQIVANIGQNRGNAGTTRIVRDVEETVDNELAAKKETDHPNKVNPLETRAMAWDEAERAKYMARYKREEVKIQAWENHEKRKAEMEMKRMEVKAERIKARAEEKYKNKLAASRRIAEEKRGNAEAELNEKAVKTSEKADYIRRTGHLPSSFSFKLPSSFCW

SEQ ID NO: 4975 - protein, 137 aa, Solanum phureja
MDTQIPILSPNNNIDEFEDLEVTQFDEDTLRKLLFEEELQPNYDNINIVQDCVIQPMVVDMAPNFSKIEEEREEEEELVIEDFEWLEMMELSDTIVSHEGVNEIFDVGELEFDFSHFCSSSIPMEEIGYDVLWQNNL

SEQ ID NO: 4976 - protein, 80 aa, Solanum lycopersicum
MDTQIPILSPNNNIDEFEDLEVTQFDEDTLRKILFEVELQPNNNSINIVQECVIQSMVIDIVSNYSKIEKEEELVIEDFD

SEQ ID NO: 4977 - protein, 246 aa, Solanum phureja
MAAAFSSSFANFAIGAQFYRPKFVKPKTFVNPIRCAGRLEWDPDGLLGPAQTGHIARLEFQRRLENDAAAREEFERQVREEKERRRVLRESRVIPDTVEGLVEFFLDTEAQEIEFEIARMRPRLNKEFFDHLQVELGKLRFSVNKTQAVEDRLIELEALQKALQEATEAYDKLQADLVATKKNLTEILTSKDVKATLLDLVGRNALNRPLLTLLDENIATAHSVNQKQAAEYMEKLRGLVLKYLTV

SEQ ID NO: 4978 - protein, 246 aa, Solanum tuberosum
MAAAFSSSFANFAIGAQFYRPKFVKPKTFVNPIRCAGRLEWDPDGLLGPAQTGHIARLEFQRRLENDAAAREEFERQVREEKERRRVLRESRVIPDTVEGLVEFFLDTEAQEIEFEIARMRPRLNKEFFDHLQVELGKLRFSVDKTQAVEDRLIELEALQKALQEATEAYDKLQADLVATKKNLTEILTSKDVKATLLDLVGRNALNRPLLTLLDENIATAHSVNQKQAAEYMEKLRGLVLKYLTV

SEQ ID NO: 4979 - protein, 248 aa, Capsicum annuum
MATAAAFGIGFTSSAIGAQFNRPKFVKPKIFVNPIRCAGRLEWDPDGILGPRQTGHIARLEFQRRLENDAAAREEFERQVREEKERRRALRESRVIPDTVEGLVEFFLDTEAQEIEFEVARLRPRLNKEFFDHLQVELGKLRFSVNKTQDVEDRLIELETLQTALQEATEAYDKLQADLVATRKNLTEIFTSKDVKATLLDLVERNQLNRPLLTLLDENIATAHSANQKQAAEYMEKLRRLVLKYLTV

SEQ ID NO: 4980 - protein, 246 aa, Nicotiana tabacum
  misc_feature (27)..(27): Xaa can be any naturally occurring amino acid
  misc_feature (237)..(237): Xaa can be any naturally occurring amino acid
MAAIFSISFASSAIGAHFHRTKFNKPXTFVNPIRCTGRLEWDPEGVLGAPQTGHIARLEFKRRLEQDAAAREEFERQVREERERRRVLRESRVIPDTVEELVEFFLDTEAQEIEFEIARLRPRLNKEFFDHLQVEVGKLRFSMTKTQEVEDRLIELEALQKALQEATEAYDKMQADIVSTKKNLTEILTSKDVKATLLELVERNELNRPLLTLLDENIATAHSVNQKQAAEYMEKLXGLVLKYLTV

SEQ ID NO: 4981 - protein, 247 aa, Nicotiana benthamiana
  misc_feature (38)..(38): Xaa can be any naturally occurring amino acid
MAAIFSISFASSAIGSSLSTGTKFNRPKTFVNPIRCAXRLEWDPEGVLGAPQTGHIARLEFKRRLEQDAAAREEFERQVREERERRRVLRESRVIPDTVEELVEYFLDTEAQEIEFEIARLRPRLNKEFFDHLQVEVGKLRFSMTKTQEVEDRLIELEALQKALQEATEAFDKMEADIVATKKNLTEILTSKDVKATLLDLVERNELNRPLLTLLDENIATAHSVNQKQAAEYMEKLRGLVLKYLTV

SEQ ID NO: 4982 - protein, 196 aa, Solanum phureja
FLLLPYLLLLLLFGLVEAEKKQKYDYGYSYFSNASITFNLLQPFPSVFQRKPALISSLRKTPHLFSYSFPKSFVPLSACLAILLWSSPANAGFLSGYTGIESVPGPELPKIDFLNRWNDDNQKKYAELDEKFKESPLLKQLLEKSKQNKEKNKKSIEDKYCLRGAEWGVGDCSTAGMTPEDRDSFIAMLKQKAGVE

SEQ ID NO: 4983 - protein, 188 aa, Solanum tuberosum
MTMATHISPMASMKQFPSTTFNLLQPFPSVFQRKPALISSLRKNHLLLSYSSPSPFENFTFPKSFVPLSACLAILLWSSPANAGFLSGYSGIESVPGPELPKIDFLNRWNDDNQKKYAELDEKFKESPLLKQLLEKSKQNKEKNKKSIEDKYCLRGAEWGVGDCSTAGMTPEDRDSFIAMLKQKAGVE

SEQ ID NO: 4984 - protein, 274 aa, Unknown
  Sequence found in Organisms: Solanum tuberosum, Solanum phureja
MSVLPKTDSIQIREVWSDNLEEEFALIRQIVDDYPYIAMDTEFPGVVLRPVGNFKHINEYNYQTLKDNVDMLNLIQLGLTFSDENGNLPTCGSEYYYIWQFNFREFDTSADIFANDSIELLIQSGIDFKKNNEMGIDAKQFGELLMSSGIVLNDMVHWVTFHSGYDFGYLLKLLTCRTLPETQAGFFDLLNMYFPLVYDIKHLMKFCNSLHGGLNKLAELLELERVGICHQAGSDSLLTSCAFKKLKDNFFNGSTEKYAGVLYGLGVEYGSDNK

SEQ ID NO: 4985 - protein, 274 aa, Nicotiana tabacum
MSALPKSDSIQIREVWSDNLEEEFALIREIVDAYPYIAMDTEFPGVVLRPVGNFKHINEYNYQTLKDNVDMLKLIQLGLTFSDENGNLPICGSERYCIWQFNFREFDTSADIFANDSIELLMQSGIDFKKNNEMGIDAKRFGELLMSSGIVLNDGVHWVTFHSGYDFGYLLKLLTCRTLPETQAGFFDLLNVYFPLVYDIKHLMKFCNSLHGGLNKLAELLELERIGICHQAGSDSLLTSCAFKKLKDNFFNGATEKYAGVLYGLGVEYGSDNK

SEQ ID NO: 4986 - protein, 274 aa, Ipomoea nil
MSELLKNDSIQIREVWNDNLEKEFALIREIVDEYPFIAMDTEFPGVVLRPVGNFKNINEYNYQTLKDNVDMLKLIQLGLTFSDEDGNLPTCGTDHYCIWQFNFREFDMSEDIFANDSIDLLRQSGIDFKKNNEMGIDATRFGELLMSSGIVLNDGVQWVTFHSGYDFGYLLKLLTCKNLPDTQSGFFDLLNMYFPIVYDIKHLMRFCNSLHGGLNKLAELLEVERIGICHQAGSDSLLTSCAFKKLKENFFSGATEKYAGVLYGLGVENGSDNK

SEQ ID NO: 4987 - protein, 188 aa, Vaccinium corymbosum
MSELAKNDPIQIREVWKENLEEEFALIRDIVDDYPYIAMDTEFPGVVLRPVGAFKNINDYNYQTLKDNVDMLKLIQLGLTFSDENGNLPTCGTDKYCIWQFNFCEFSVSEDIFANDSIELLKQCGIDFKKNNEMGIDANRFGELLMSSGIVLNDNVHWVTFHSGYDFGYLLKLLTCRDLPDTQAGFLT

SEQ ID NO: 4988 - protein, 275 aa, Actinidia deliciosa
MSEMPKGDDSIQIREVWESNLEEEFALIREIVDDFPFIAMDTEFPGVVLRPVGTFKNINDYNYQTLKDNVDMLKLIQLGLTFSDENGNLPTCGSDKFCIWQFNFCEFNVGEDIFANDSIELLRQCGIDFKKNNEMGIDANRFGELLMSSGIVLNDNVHWVTFHSGYDFGYLLKLLTCRNLPDSQAGFFDLINIYFPVVYDIKHLMKFCNSLHGGLNKLAELLEVERIGICHQAGSDSLLTSCAFKKLKDNFFNGSTEKYAGVLYGLGVENASENK

SEQ ID NO: 4989 - protein, 273 aa, Tabernaemontana elegans
MSDLAKGDSIHIREVWNDNLEEEFALIREIVDDYPYIAMDTEFPGVVLRPVGSFKHINEYNYQTLKDNVDMLKLIQLGLTFSDEKGNLPTCGTDVGCIWQFNFREFNVNEDIFANDSIELLKQSGIDFQKNNDMGIDANRFAELLMSSGIVLNDSVRWVTFHSGYDFGYLLKLLTCRSLPDTQAGFLDLIKMYFPMVYDVKHLMKFCNSLHGGLSKLAELLEVERIGICHQAGSDSLLTSCAFKKLKDNFFNGSTEKYAGVLYGLGVEFGSEK

SEQ ID NO: 4990 - protein, 110 aa, Fraxinus spp
MEEIPELPKNDSIQIREVWNDNLEQELALIREIVDDYPYIAMDTEFPGVVLRPVRNFKHINEYNYQTLKDNVDMLKLIQLGLTFSDENGNLPTCGTDTCCIWQFNSVNSM

SEQ ID NO: 4991 - protein, 271 aa, Sesamum indicum
MFELPKNDQIQIREVWNDNLEQEFALIRDIVDGYPYVAMDTEFPGVVLRPVGNFNHINQYNYQTLKDNVDMLKLIQLGLTFSDENGNLPTCGTNTCCIWQFNFREFNVSEDIFANDSIELLRQSGIDFKKNNELGIDAGRFAELLMSSGIVLNDGMCWVTFHSGYDFGYLLKLLTCRSLPETPAGFFLLLNIYFPMVYDIKHLMKFCNSLHGGLNKLAELLEVERIGVCHQAGSDSLLTSCAFKKLKDNFFNGSTEKYAGVLYGLGIENGS

SEQ ID NO: 4992 - protein, 273 aa, Scabiosa columbaria
MSLFEKSDLIQIREVWNDNLEEEFALIREIVDDYPFIAMDTEFPGVVLRPVGAFKNINEYNYQTLKDNVDMLKLIQLGLTFSDKNGNLPTCGTDSYCIWQFNFREFNMSEDIFANDSMELLTQSGIDFKKNNEMGIDASRFGELFMSSGIVLNDGVQWVTFHSGYDFGYLLKLLTCRELPDTQAGFFKLINMYFPMVYDIKHLMKFCNSLHGGLNKLAELLEVERIGICHQAGSDSLLTACTFNKLKDNFFNGSTEKYAGVLYGLGVENGNDK

SEQ ID NO: 4993 - protein, 276 aa, Lippia dulcis
MSELPKPDSIQIREVWNENLEQEFALIRDIVDNYPYVAMDTEFPGVVLRPVGNFNHIHEYNYQTLKDNVDMLKLIQLGLTFSDEDGNLPTCGTDTGCIWQFNFREFNLTKDIFANDSIELLKQSGIDFKKNNEMGIDSNRFAELLMSSGIILNDNVHWVTFHSGYDFGYLLKLLTCKSLPETPAGFFDLLKMYFPVVYDIKHLMKFCNSLHGGLNKLAELLEVERFGICHQAGSDSLLTSCAFKKLKDNFFNGDTEKYVGVLYGLGVENGTDKSWA

SEQ ID NO: 4994 - protein, 270 aa, Antirrhinum majus
  misc_feature (155)..(156): Xaa can be any naturally occurring amino acid
MSDLPTKESIQIREVWNENLEQEFALIREIVDDYPYIAMDTEFPGVVLRPVGNFKHINEYNYQTLKDNVDMLKLIQLGLTLSDENGNLPSCEAGTCCIWQFNFREFNVGQDMFADDSIELLRQSGIDFTKNNEMGIDVGRFAELLMSSGIVLNDXXCWVTFHSGYDFGYLLKLLTCRKLPETQSGFFDLLRMYFLMVYDIKHLMKFCGGLHGGLNKLAELLEVERFGICHQAGSDSLLTSSAFKKLKDNFFNGSTEKYAGVLHGLGVEYG

SEQ ID NO: 4995 - protein, 273 aa, Glycine max
MSILPKGDSVQIREVWNDNLEEEFALIREIVDEYNYVAMDTEFPGVVLRPVGNFKNINDYNYQTLKDNVDMLKLIQLGLTFSDENGNLPTCGTESTCIWQFNFREFNISEDIFASDSIELLRQCGIDFKKNSEKGIDVNRFGELLMSSGIVLNDAVHWVTFHSGYDFGYLLKLLTCRSLPETQAGFFDLIKMYFPMVYDIKHLMKFCNSLHGGLNKLAELLEVERVGVCHQAGSDSLLTSCTFRKLRDAFFSGSTEKYAGVLYGLGVESGQTN

SEQ ID NO: 4996 - protein, 274 aa, Fagus grandifolia
MSILPKGDSIQIREVWNDNLEEEFALIREIVDGYNFIAMDTEFPGVVLRPVGTFKNINDYNYQTLKDNVDMLKLIQLGLTFSDGNGNLPTCGTDKFCVWQFNFREFNVSDDIFASDSIELLHQCGIDFKKNNEKGIDVNRFGELLMSSGIVLNDGVHWVTFHSGYDFGYLLKLLTCRSLPDTQAGFFDLINMYFPMVYDIKHLMKFCNSLHGGLNKLAELLDVERVGVCHQAGSDSLLTACTFRKLRDSFFNGSTEKYAGVLYGLGVENGQSTN

SEQ ID NO: 4997 - protein, 273 aa, Vigna unguiculata
MSIIPKGDSVQIREVWNDNLEEEFALIREIVDEYNYVAMDTEFPGVVLRPVGNFKNINDYNYQTLKDNVDMLKLIQLGLTFSDENGNLPTCGSESPCIWQFNFREFNISEDIFASDSIELLRQCGIDFKKNSEKGIDVNRFGELLMSSGIVLNDAVHWVTFHSGYDFGYLLKLLTCRSLPDTQAGFFDLIKMYFPMVYDIKHLMKFCNSLHGGLNKLAELLEVERVGVCHQAGSDSLLTSCTFRKLRDTFFSGSTEKYAGVLYGLGVENGQTN

SEQ ID NO: 4998 - protein, 272 aa, Mimulus guttatus
MSELPKNDSVTIREVWNDNLEQEFALIRDIVDNYPYVAMDTEFPGVVLRPLGSFNHIHEYNYQTLKDNVDMLKLIQLGLTFSDENGNLPTCDNTCCIWQFNFREFNVSEDIFANDSIELLRESGIDFKKNNEAGIDASHFAELLMSSGIVLNDNVRWVTFHSGYDFGYLLKLLTCRSLPESAVGFFNMLNLYFPVVYDIKHLMKFCNSLHGGLNKLAELLEIERIGICHQAGSDSLLTSSAFKKLKDNFFNGFTEKYAGVLYGLGVENGFEK

SEQ ID NO: 4999 - protein, 275 aa, Euphorbia peplus
MSILQKGDSIHIREVWNDNLEEEFTLIREIVDQFNYVAMDTEFPGVVLRPVGNFKNINDYNYQTLKDNVDMLKLIQLGLTFSDENGNLPTCGTDKFCIWQFNFREFNITEDIFASDSIELLRQCGIDFKMNSEKGIDVSRFGELLMSSGIVLNDGVNWVTFHSGYDFGYLLKLLTCRMLPETQSGFFDLINMYFPMVYDIKHLMKFCNSLHGGLNKLAELLEVERVGVCHQAGSDSLLTSCTFRKLRDNFFNGSTEKYAGVLYGLGVENGQNNTN

SEQ ID NO: 5000 - protein, 274 aa, Ricinus communis
MSIIPKGDSIHIREVWNDNLEEEFTLIREIVDQFNYVAMDTEFPGVVLRPVGNFKNINDYNYQTLKDNVDMLKLIQLGLTFSDENGNLPTCGTDKFCIWQFNFREFNISEDIFASDSIELLRQCGIDFKKNNEKGIDVNRFGELMMSSGIVLNDGVHWVTFHSGYDFGYLLKLLTCRSLPDTQAGFFDLINTYFPMVYDIKHLMKFCNSLHGGLNKLAELLEVERVGICHQAGSDSLLTSCTFRKLRDNFFNGSTEKYAGVLYGLGVENGQNTI

SEQ ID NO: 5001 - protein, 273 aa, Phaseolus vulgaris
MSIIPKGDSVQIREVWNDNLDEEFALIREIVDEYNYVAMDTEFPGVVLRPVGNFKNINDYNYQTLKDNVDMLKLIQLGLTFSDENGNLPTCGSESPCIWQFNFREFNISEDIFASDSIELLRQCGIDFKKNSEKGIDVNRFGELLMSSGIVLNDAVHWVTFHSGYDFGYLLKLLTCRSLPDTQTGFFDLIKMYFPMVYDIKHLMKFCNSLHGGLNKLAELLEVERVGVCHQAGSDSLLTSCTFRKLRDTFFNGSTEKYSGVLYGLGVENGQTN

SEQ ID NO: 5002 - protein, 274 aa, Manihot esculenta
MSLLLKGDSIQIREVWDDNLEEEFALLREIVDDYPYIAMDTEFPGIVLRPVGNFKNSNEYHYQTLKDNVDMLKLIQLGLTFSDEQGNLPTCGTDKYCIWQFNFREFNVNEDVFANDSIELLRQSGIDFKKNNEKGIDAKKFGELLMSSGIVLNDSVHWVTFHSGYDFGYLLKLLTCQNLPDTQVGFFNLIKMYFPTLYDIKHLMKFCNSLHGGLNKLAELLEVERVGICHQAGSDSLLTACTFRKLKENFFSGSLEKYAGVLYGLGVENGVNTN

SEQ ID NO: 5003 - protein, 273 aa, Glycine max
MSILPKGDSVQIREVWNDNLEEEFALIREIVDEYNYVAMDTEFPGVVLRPVGNFKNINDYNYQTLKDNVDMLKLIQLGLTFSDENGNLPTCGTESPCIWQFNFREFNVSEDIFASDSIELLRQCGIDFKKNSENGIDVNRFGELLMSSGIVLNDSVRWVTFHSGYDFGYLLKLLTCRSLPDTQAGFFDLIKMYFPMVYDIKHLMKFCNSLHGGLNKLAELLEVERVGVCHQAGSDSLLTSCTFRKLRDTFFSGSTEKYAGVLYGLGVESGQTN

SEQ ID NO: 5004 - protein, 274 aa, Unknown
  Sequence found in Organisms: Citrus sinensis, Citrus clementina, Citrus sinensis
MSVLPKGGDEIQIREVWNDNLEEEFALIREIVDKYNYIAMDTEFPGVVLRPVGAFKNINDYNYQTLKDNVDMLKLIQLGLTFSDENGNLPTCGTDKFCIWQFNFREFNLIDDIFASDSVELLHQCGIDFKKNNEKGIDVNRFGELLMSSGIVLNDVVRWVTFHSGYDFGYLLKLLTCRSLPDTQAGFFELINMYFPVVYDIKHLMKFCNSLHGGLNKLAELLEVERVGICHQAGSDSLLTSCTFRKLRENFFNGCTEKYAGVLYGLGVENDKTN

SEQ ID NO: 5005 - protein, 234 aa, Phaseolus vulgaris
MSIIPKGDSVQIREVWNDNLDEEFALIREIVDEYNYVAMDTEFPGVVLRPVGNFKNINDYNYQTLKDNVDMLKLIQLGLTFSDENGNLPTCGSESPCIWQFNFREFNISEDIFASDSIELLRQCGIDFKKNSEKGIDVNRFGELLMSSGIVLNDAVHWVTFHSGYDFGYLLKLLTCRSLPDTQTGFFDLIKMYFPMVYDIKHLMKFCNSLHGGLNKLAELLEVERVGVCHYGRV

SEQ ID NO: 5006 - protein, 274 aa, Gossypium raimondii
MSVLPKGDSVHIREVWNDNLEEEFALIREIVDTYNYVAMDTEFPGVVLRPVGSFKNISDYNYQTLKDNVDMLKLIQLGLTFSDENGNLPTCGTDSSCIWQFNFCEFNISEDIFASDSIELLRQCGIDFKKNNEKGIDVKRFGELLMSSGIVLNDGVHWVTFHSGYDFGYLLKLLTCRSLPDNQAGFFDLINMYFPMLYDIKHMMKFCNSLHGGLNKLAELLEVERVGVCHQAGSDSLLTSCTFRKLRDNFFNGSTEKYAGVLYGLGVESGQTTN

SEQ ID NO: 5007 - protein, 274 aa, Theobroma cacao
MSLLPKSDSIQIREVWNDNLEEEFALIREIVDDYPYVAMDTEFPGVVLRPLGNFKYICDYNYQTLKDNVDMLKLIQLGLTFSDEEGNLPTCGTDKYCIWQFNFREFNVNEDVFANDSIELLRQSGIDFKKNNEKGIDAMRFGELLMSSGIVLNDSVHWVTFHSGYDFGYLLKLLTCQNLPDTQVGFFSLINIYFPTLYDIKHLMKFCNSLYGGLNKLAELLEVERVGICHQAGSDSLLTSCTFMKLKENFFSGSLEKYSGVLYGLGVENGQSTH

SEQ ID NO: 5008 - protein, 274 aa, Manihot esculenta
MSIIPKGDSIQIREVWNDNLEEEFALIREIVDQFNYVAMDTEFPGVVLRPVGNFKNINDYNYQTLKDNVDMLKLIQLGLTFSDEKGNLPSCGTDKSCIWQFNFREFNISEDIFASDSIELLRQCGIDFKKNNEKGIDVNRFGELLMSSGIVLNDGVHWVTFHSGYDFGYLLKLLTCRSLPDTQAGFFDLINMYFPMVYDIKHLMKFCNSLHGGLNKLAELLEVERVGVCHQAGSDSLLTSCTFRKLRDNFFSGSTEKYAGVLYGLGVENGQNTN

SEQ ID NO: 5009 - protein, 277 aa, Glycine max
MPLVLAKSDSIQIREVWNDNLEEEFALIREIVDDYPYIAMDTEFPGIVLRPVGNFKNSYDYHYQTLKDNVDMLKLIQLGLTFSDEHGNLPTCGDESGTCCIWQFNFREFNVNEDVFANDSIELLRQSGIDFKRNNENGIDAHRFGELLMSSGIVLNDNVHWVTFHSGYDFGYLLKLLTCQDLPDTQVGFFNLINMYFPTVYDIKHLMKFCNSLHGGLNKLAELLEVERVGICHQAGSDSLLTSCTFRKLKDNFFSGSLEKYAGVLYGLGVENGQGSH

SEQ ID NO: 5010 - protein, 274 aa, Amsonia hubrichtii
MSDLPKGDPIHIREVWNDNLEEEFALIREIVDDYPYIAMDTEFPGVVLRPVGTFKNINEFNYQTLKGNVDMLKLIQLGLTFSDEKGNLPTCGTDVGCIWQFNFREFNVSEDIFANDSIELLKQSGIDFQKNNDIGIDANRFAELLMSSGIVLNDSVHWVTFHSGYDFGYLLKLLTCRSLPDTQAGFFDLIRMYFPMVYDIKHLMKFCNSLHGGLNKLAELLEVERIGICHQAGSDSLLTSCAFKKLKDNFFNGSTEKYARGFIWSWCLSIGSDK

SEQ ID NO: 5011 - protein, 274 aa, Ricinus communis
MSLLLKGDSIQIREVWNDNLEEEFSLIREIVDEYSYIAMDTEFPGIVLRPVGNFKNSNEYHYQTLKDNVDMLKLIQLGLTFSDEQGNLPTCGTDKYCIWQFNFREFNVNEDVFANDSIELLRQSGIDFKKNNERGIDAMRFGELLMSSGIVLNDSVHWVTFHSGYDFGYLLKLLTCQNLPDTQLGFFNLINMYFPTLYDIKHLMKFCNSLHGGLNKLAELLEVERVGICHQAGSDSLLTACTFRKLKENFFSGSLEKYAGVLYGLGVENGQSTH

SEQ ID NO: 5012 - protein, 273 aa, Primula obconica
MSELSKSDSIEIREVWNDNLEEEFALIREIVDEYPYIAMDTEFPGVVLRPVGAFKNINDFNYQTLKDNVDMLKLIQLGLTLSDEDGNLPTCGTGKYCIWQFNFREFNLTDDIFANDSIELLKQCGIDFKKNNEMGIEVNRFAELLMSSGVVLNDRVNWVTFHSGYDFGYLLKLLTCRSLPDTQAGFFYLISTYFPLVYDIKHLMKFCNSLHGGLNKLAEILEVERIGICHQAGSDSLLTLCAFKKLKDNFFNGFTEKYAGVLYGLGVESGPEK

SEQ ID NO: 5013 - protein, 274 aa, Gossypium hirsutum
MSVLPKGDSVHIREVWNDNLEEEFALIREIVDTYNYVAMDTEFPGVVLRPVGSFKNISDYNYQTLKDNVDMLKLIQLGLTFSDENGNLPSCGTDSSCIWQFNFCEFNISEDIFASDSIELLRQCGIDFKKNNEKGIDVKRFGELLMSSGIVLNDGVHWVTFHSGYDFGYLLKLLTCRSLPDNQAGFFDLINMYFPMLYDIKHMMKFCNSLHGGLNKLAELLEVERVGVCHQAGSDSLLTSCTFRKLRDNFFNGSTEKYAGVLYGLGVESGQTTN

SEQ ID NO: 5014 - protein, 275 aa, Carica papaya
MSVLLKSDSIQIREVWNDNLDEEFALIREIVDTYNYVAMDTEFPGVVLRPVGNFKNISDYNYQTLKDNVDMLKLIQLGLTFSDENGSLPTCGTDKFCIWQFNFREFNVTEDIFASDSIELLRQCGIDFKKNNEKGIDVNRFGELLMSSGIVLNDNVHWVTFHSGYDFGYLLKLLTCRNLPDSQAGFFDLINMYFPMVYDIKHLMKFCNSLHGGLNKLAELLEVERVGICHQAGSDSLLTSCTYRKLRDSFFSGSTEKYAGVLYGLGVENGQNTTN

SEQ ID NO: 5015 - protein, 274 aa, Amborella trichopoda
MSILPKNETILIREVWGDNLEDEFALIREIVDDYPYIAMDTEFPGIVLRPVGNFKNSSDFHYKTLKANVDMLKLIQLGLTFSDEDGNLPTCGTDKFYIWQFNFREFNVLEDVYANDSIELLRQSGIDFKKNNEKGIDAQRFGELLMSSGIVLNDTVHWVTFHSGYDFGYLLKLLTCQNLPETQAGFFGLINMYFPTVYDIKHLMKFCNSLHGGLNKLAELLDVERIGICHQAGSDSLLTSCTFRKLKESFFNGSTEKYAGVLYGLGVENGNSIN

SEQ ID NO: 5016 - protein, 273 aa, Theobroma cacao
MSLLPKGDSIQIREVWNDNLEEEFALIREIVDDYPYVAMDTEFPGVVLRPLGNFKNSYDYHYQTLKDNVDMLKLIQLGLTFSDEEGNLPTCATDKYCIWQFNFREFNVNEDVFANDSIELLRQSGIDFKKNNEKGIDAMRFGELLMSSGIVLNDSVHWVTFHSGYDFGYLLKLLTCQNLPDTQAGFFSLINIYFPTLYDIKHLMKFSNSLYGGLNKLAELLEVERVGICHQAGSDSLLTSCTFRKLKENFFSGSLEKYSGVLYGLGVENGQSN

SEQ ID NO: 5017 - protein, 272 aa, Catharanthus roseus
MSDLTKGDSVHIREVWNHNLEEEFALIRELVDDYPYVAMDTEFPGVVLRPVGTFKNINDYNYLTLKDNVDMLKLIQLGLTFSDEEGNLPTCGFDVGCIWQFNFREFNLNEDMFANDSIELLKQSGIDFQKNNDMGIDANRFAELLMSSGIVLNDSVHWVTFHSAYDFGYLLKLLTCKSLPDSQAGFFNLIKIYFPMVYDIKHLMKFCNSLHGGLNKLAELLEVERFGICHQAGSDSLLTSCAFKKLKDNFFNGSTEKYAGVLYGLGEYGSEK

SEQ ID NO: 5018 - protein, 274 aa, Gossypium hirsutum
MSVLPKGDSVHIREVWNDNLEEEFALIREIVDTYNYVAMDTEFPGVVLRPVGSFKNISDYNYQTLKDNVDMLKLIQLGLTFSDENGNLPSCGTDSSCIWQFNFCEFNISEDIFASDSIELLRQCGIDFKKNNEKGIDVKRFGELLMSSGIVLNDGVHWVTFHSGYDFGYLLKLLTCRSLPDNQARFFDLINMYFPMLYDIKHMMKFCNSLHGGLNKLAELLEVERVGVCHQAGSDSLLTSCTFRKLRDNFFNGSTEKYAGVLYGLGVESGQTTN

SEQ ID NO: 5019 - protein, 273 aa, Arachis hypogaea
MSILPKGDSVQIREVWNDNLEEEFALIREIVDEYNYVAMDTEFPGVVLRPVGNFKNINDYNYQTLKDNVDMLKLIQLGLTFSDEHGNLPTCGTESSCIWQFNFREFNISEDIFASDSIELLRQCGIDFKKNNEKGIDVNRFGELLMSSGIVLNDSVSWVTFHSGYDFGYLLKLLTCRSLPDTQAGFFELIKMYFPMLYDIKHLMKFCNSLHGGLNKLAELLDVERVGVCHQAGSDSLLTSCTFRKLRDTFFSGSTEKYAGVLYGLGVENGQTN

SEQ ID NO: 5020 - protein, 277 aa, Cannabis sativa
MSLLPKSDSIHIREVWDGNLEDEFALIREIVDEYPYVAMDTEFPGIVLRPVGNFKNSYDFHYQTLKDNVDMLKLIQLGLTFSDEDGNLPTCGTDKYCIWQFNFREFNVNEDVFANDSIELLRQSGIDFMKNNENGIDVKRFGELLMSSGIVLNDNVHWVTFHSGYDFGYLLKLLTCQDLPETQLGFFNLINMYFPTVYDIKHLMKFCNSLHGGLNKLAELLEVERVGICHQAGSDSLLTSCTFRKLKENFFSGSMTKYAGVLYGLGVENGQNITQPY

SEQ ID NO: 5021 - protein, 274 aa, Amborella trichopoda
  misc_feature (230)..(230): Xaa can be any naturally occurring amino acid
MSILPKNETILIREVWGDNLEDEFALIREIVDDYPYIAMDTEFPGIVLRPVGNFKNSSDFHYKTLKANVDMLKLIQLGLTFSDEDGNLPTCGTDKFYIWQFNFREFNVLEDVYANDSIELLRQSGIDFKKNNEKGIDAQRFGELLMSSGIVLNDTVHWVTFHSGYDFGYLLKLLTCQNLPETQAGFFGLINMYFPTVYDIKHLMKFCNSLHGGLNKLAELLDVERIGICXQAGSDSLLTSCTFRKLKESFFNGSTEKYAGVLYGLGVENGNSIN

SEQ ID NO: 5022 - protein, 276 aa, Cajanus cajan
MPLILAKSDSIEIREVWNDNLEEEFALIREIVDDYPYIAMDTEFPGIVLRPVGNFKNSYDYHYQTLKDNVDMLKLIQLGLTFSDEHGNLPTCGPAHTCCIWQFNFREFNVNEDVFANDSIELLRQSGIDFTKNNQNGIDARRFGELLMSSGIVLNDNVHWVTFHSGYDFGYLLKLLTCQNLPDTQVGFFNLINMYFPTVYDIKHLMKFCNSLHGGLNKLAELLEVERVGICHQAGSDSLLTSCTFRKLKDNFFSGSLEKYAGVLYGLGVENGQGSY

SEQ ID NO: 5023 - protein, 275 aa, Populus trichocarpa
MSIAPPKEDSIQIREVWNDNLEEEFALIREIVDQFNHVAMDTEFPGVVLRPVGNFKNISDYNYQTLKDNVDMLKLIQLGLTFSDENGNLPTCGTDKFCIWQFNFREFNVTEDIFASDSIELLRQCGIDFKKNSEMGIDVNRFGELLMSSGIVLNDGVNWVTFHSGYDFGYLLKLLTCRSLPDSQAGFFDLINMYFPMVYDIKHLMKFCNSLHGGLNKLAELLEVERIGVCHQAGSDSLLTSSTFKKLKDNFFSGSTEKYAGVLYGLGVENGQNTN

SEQ ID NO: 5024 - protein, 275 aa, Populus trichocarpa
MSIAPPKEESIQIREVWNDNLEEEFALIREIVDQFNFVAMDTEFPGVVLRPVGNFKNINDYNYQTLKDNVDMLKLIQLGLTFSDENGNLPTCGTDKFCIWQFNFREFNVTKDIFASDSIELLRQCGIDFKMNNEKGIDVNQFGELLMSSGIVLNDGVHWVTFHSGYDFGYLLKLLTCRSLPDTPAGFFDLINMYFPVVYDIKHLMKFCNSLHGGLNKLAELLEVERIGVCHQAGSDSLLTSCTFRKLRDNFFNGSAEKYAGVLYGLGVENGQNTS

SEQ ID NO: 5025 - protein, 274 aa, Vinca minor
MSDLEKGDSIHIREVWNHNLEEEFGLIRELVDNYPYVAMDTEFPGVVLRPVGTFKNINDYNYQTLKDNVDMLKLIQLGLTFSDEDGNLPICGGSDVGCIWQFNFREFDVNEDMFANDSIELLKQSGIDFQKNNDMGIDVNRFSELLMSSGIVMNDSVHWVTFHSAYDFGYLLKILTCKNLPETQAGFFDLIKIYFPIVYDIKHLMKFCNSLHGGLNKLAELLEVERFGICHQAGSDSLLTSCTFKKLKDSFFNGSTDKYAGVLYGLGVEYGSDK

SEQ ID NO: 5026 - protein, 549 aa, Solanum phureja
MALQQPFLSELLHSSSKRTTLPKSSLFSLQIPQRFNFYLQNKQFKKQGRSCYAIAENLGAEVLDEDQSVILENSSLDELRGQREIVGYDWTEEWYPLYLTKNVPDDAPLGLTVFDKQVVLYKDGSGELRCFEDRCPHRLAKLSEGQLYDGKLECLYHGWQFDGDGKCVKIPQLPENAKIPRSACTKTYEIRDSQGVVWIWMSHRTPPNVNKIPWFENFDRKGFRDISTIHELPYDHSILLENLMDPAHVPISHDRTDFTAKREDAGPLFFEVTERTNRGFAGWWGKEKDQGKANYTPNFLRFESPCVLQNNREIVDESGEKHYFSGLFLCRPSGQGKSMLIVRFGNTRKRTGILKFIPNWFLHQNASKVFEQDMGFLSSQNEILMKEKVPTKKLYLNLKSSDTWVAEYRKWMDKVGHGMPYHFGHSTIFLPQQPAVVEHAPAGFVANFSAAQPAKGGIGDMYAPNPANRYFRHVVHCRDCSNVVKAFETWKKALSVIALVSTAFAILVSGRQWKALLLLWTSLCLAGAYACSTAIAMNTTNFIRTHRRL

SEQ ID NO: 5027 - protein, 152 aa, Solanum tuberosum
MASSKNFLIFILAALIATPVAVAQLGGLLGGILGTISIDGVLFCSLNGKIDVLNGATTPIFPNASVQLRCGGGNVVSSTTTNGSGAFSLLLNPVQNILVSSLLSNCNIVVTTPLSTCNATLPSVGVLQAPLQIVGRAAGLLNIVTGAFQLIN

SEQ ID NO: 5028 - protein, 155 aa, Solanum phureja
MASSKIFLIFILAALIATPVAVAQLGGLLGGLLGPISIDGVLFCSLNGKIDVLNGATTPIFPNASVQLRCGAGNVVSSTTTNGSGAFSLVLNPVQNILSSLLSNCNIVVTTPLSTCNASLPSVGVLQAPLQIVGRTTGGLVNLVTGVFQLIPLLN

SEQ ID NO: 5029 - protein, 112 aa, Ocimum basilicum
MASFGEAPPGNPKAGEKIFKTKCAQCHTVDKGAGHKQGPNLNGLFGRQSGTTAGYSYSNANKNMAVNWGENTLYDYLLNPKKYIPGTKMVFPGLKKPQERADLIAYLKEATA

SEQ ID NO: 5030 - protein, 112 aa, Solanum melongena
MASFAEAPPGNPKAGEKIFKTKCAQCHTVDKGAGHKQGPNLNGLFGRQSGTTAGYSYSAANKNMAVTWGENTLYDYLLNPKKYIPGTKMVFPGLKKPQERADLIAYLKEATA

SEQ ID NO: 5031 - protein, 112 aa, Unknown
  Sequence found in Organisms: Solanum tuberosum, Solanum phureja
MASFGEAPPGNPKAGEKIFKTKCAQCHTVDKGAGHKQGPNLNGLFGRQSGTTAGYSYSNANKNMAVTWGENTLYDYLLNPKKYIPGTKMVFPGLKKPQDRADLIAYLKEATA

SEQ ID NO: 5032 - protein, 112 aa, Capsicum annuum
MASFGEAPPGNPKAGEKIFKTKCAQCHTVDKGAGHKQGPNLNGLFGRQSGTTPGYSYSAANKNMAVNWGEDTLYDYLLNPKKYIPGTKMVFPGLKKPQERADLIAYLKEATA

SEQ ID NO: 5033 - protein, 112 aa, Antirrhinum majus
MASFNEAPPGNSKAGEKIFKTKCAQCHTVDKGAGHKQGPNLNGLFGRQSGTTPGYSYSAANKSMAVNWGENTLYDYLLNPKKYIPGTKMVFPGLKKPQERADLIAYLKEATA

SEQ ID NO: 5034 - protein, 112 aa, Quercus alba
MASFAEAPPGNPKAGEKIFKTKCAQCHTVDKGAGHKQGPNLNGLFGRQSGTTPGYSYSAANKNMAVNWGENTLYDYLLNPKKYIPGTKMVFPGLKKPQDRADLISYLKESTA

SEQ ID NO: 5035 - protein, 113 aa, Eragrostis curvula
MASFSEAPPGNPKAGEKIFKTKCAQCHTVDKGAGHKQGPNLNGLFGRQSGTTAGYSYSAANKNMAVIWEENTLYDYLLNPKKYIPGTKMVFPGLKKPQERADLIAYLKEATSS

SEQ ID NO: 5036 - protein, 112 aa, Amorphophallus konjac
MASFAEAPPGDPKAGEKIFKTKCAQCHTVDKGAGHKQGPNLNGLFGRQSGTTPGYSYSTANKNMAVTWGESTLYDYLLNPKKYIPGTKMVFPGLKKPQERADLIAYLKESTA

SEQ ID NO: 5037 - protein, 112 aa, Petunia hybrida
MASFTEAPPGNEKAGEKIFKTKCAQCHTVDKGAGHKQGPNLSGLFGRQSGTTAGYSYSTANKNMAVTWGENTLYDYLLNPKKYIPGTKMVFPGLKKPQERADLIAYLKSATA

SEQ ID NO: 5038 - protein, 112 aa, Lippia dulcis
MASFDEAPPGNSKAGEKIFKTKCAQCHTVDKGAGHKQGPNLNGLFGRQSGTAAGYSYSAANKNKAVNWEENTLYDYLLNPKKYIPGTKMVFPGLKKPQERADLIAYLKEATA

SEQ ID NO: 5039 - protein, 112 aa, Solanum phureja
MASFGEAPPGNEKAGEKIFKTKCAQCHTVEKGAGHKQGPNLNGLFGRQSGTTAGYSYSAANKNMAVTWGENTLYDYLLNPKKYIPGTKMVFPGLKKPQERADLIAYLKSATA

SEQ ID NO: 5040 - protein, 112 aa, Amorphophallus konjac
MASFAEAPPGNPKAGEKIFKTKCAQCHTVEKGAGHKQGPNLNGLFGRQSGTTPGYSYSTSNKNMAVIWGEPTLYDYLLNPKKYIPGTKMVFPGLKKPQERADLIAYLKESTA

SEQ ID NO: 5041 - protein, 112 aa, Setaria italica
MASFSEAPPGNPAAGEKIFKTKCAQCHTVDKGAGHKQGPNLNGLFGRQSGTTPGYSYSSANKNMAVIWEENTLYDYLLNPKKYIPGTKMVFPGLKKPQERADLIAYLKNATA

SEQ ID NO: 5042 - protein, 112 aa, Cucurbita pepo
MASFDEAPPGNSKAGEKIFKTKCAQCHTVDKGAGHKQGPNLNGLFGRQSGTTAGYSYSAANKNMAVIWEEKTLYDYLLNPKKYIPGTKMVFPGLKKPQDRADLIAYLKEATA

SEQ ID NO: 5043 - protein, 112 aa, Pennisetum glaucum
MASFSEAPPGNPKAGEKIFKTKCAQCHTVDKGAGHKQGPNLNGLFGRQSGTTAGYSYSAGNKNKAVVWEENTLYEYLLNPKKYIPGTKMVFPGLKKPQERADLIAYLKEATA

SEQ ID NO: 5044 - protein, 112 aa, Mimulus guttatus
MASFDEAPPGDGKAGEKIFKTKCAQCHTVDKGAGHKQGPNLNGLFGRQSGTTPGYSYSTANKSMAVNWGENTLYDYLLNPKKYIPGTKMVFPGLKKPKERADLIAYLKEATA

SEQ ID NO: 5045 - protein, 112 aa, Raphanus sativus
MASFDEAPPGNPKAGEKIFRTKCAQCHTVDKGAGHKQGPNLNGLFGRQSGTTAGYSYSAANKNKAVEWEEKTLYDYLLNPKKYIPGTKMVFPGLKKPQERADLIAYLKEATA

SEQ ID NO: 5046 - protein, 112 aa, Oryza sativa
MASFSEAPPGNPKAGEKIFKTKCAQCHTVDKGAGHKQGPNLNGLFGRQSGTTPGYSYSTANKNMAVIWEENTLYDYLLNPKKYIPGTKMVFPGLKKPQERADLISYLKEATS

SEQ ID NO: 5047 - protein, 112 aa, Sesamum indicum
MASFNEAPPGDVKSGEKIFKTKCAQCHTVDKGAGHKQGPNLNGLFGRQSGTTPGYSYSAANKNMAVIWGENTLYDYLLNPKKYIPGTKMVFPGLKKPQERADLIAYLKEATA

SEQ ID NO: 5048 - protein, 112 aa, Sorghum bicolor
MASFSEAPPGNPKAGEKIFKTKCAQCHTVEKGAGHKQGPNLNGLFGRQSGTTAGYSYSAGNKNKAVVWEENTLYDYLLNPKKYIPGTKMVFPGLKKPQERADLIAYLKEATA

SEQ ID NO: 5049 - protein, 112 aa, Solanum lycopersicum
MASFGEAPAGNEKAGEKIFKTKCAQCHTVEKGAGHKQGPNLNGLFGRQSGTTAGYSYSAANKNMAVTWGENTLYDYLLNPKKYIPGTKMVFPGLKKPQERADLIAYLKSATA

SEQ ID NO: 5050 - protein, 112 aa, Musa acuminata
MASFAEAPPGDPKAGEKIFKTKCAQCHTVDKGAGHKQGPNLNGLFGRQSGTTPGYSYSTANKNMAVIWEESTLYDYLLNPKKYIPGTKMVFPGLKKPQERADLIAYLKQSTA

SEQ ID NO: 5051 - protein, 112 aa, Ricinus communis
MATFEQAPPGESKAGEKIFKTKCAQCHTVDKGAGHKQGPNLNGLFGRQSGTTAGYSYSSANKNMAVIWSENTLYDYLLNPKKYIPGTKMVFPGLKKPQERADLIAYLKEATA

SEQ ID NO: 5052 - protein, 112 aa, Gossypium hirsutum
MASFEQAPPGNAKAGEKIFKTKCAQCHTVDKGAGHKQGPNLNGLFGRQSGTTPGYSYSAANKNMAVIWGENTLYDYLLNPKKYIPGTKMVFPGLKKPQDRADLIAYLKESTA

SEQ ID NO: 5053 - protein, 112 aa, Eschscholzia californica
MASFDEAPPGNPKAGEKIFKTKCAQCHTVEKGAGHKQGPNLNGLFGRQSGTTAGYSYSAANKNMAVNWEEKTLYDYLLNPKKYIPGTKMVFPGLKKPQDRADLIAYLKESTC

SEQ ID NO: 5054 - protein, 112 aa, Unknown
  Sequence found in Organisms: Setaria italica, Panicum virgatum
MASFSEAPPGNPKAGEKIFKTKCAQCHTVEKGAGHKQGPNLNGLFGRQSGTTAGYSYSAGNKNKAVVWEENTLYEYLLNPKKYIPGTKMVFPGLKKPQERADLIAYLKEATA

SEQ ID NO: 5055 - protein, 112 aa, Unknown
  Sequence found in Organisms: Raphanus sativus, Eutrema parvulum
MASFDEAPPGNSKAGEKIFRTKCAQCHTVDKGAGHKQGPNLNGLFGRQSGTTAGYSYSAANKNKAVEWEEKTLYDYLLNPKKYIPGTKMVFPGLKKPQERADLIAYLKEATA

SEQ ID NO: 5056 - protein, 113 aa, Aquilegia formosa
MASFDEAPPGNPKAGEKIFKTKCAQCHTVEKGAGHKQGPNLNGLFGRQSGTTAGYSYSAANKNMAVNWEEKTLYDYLLNPKKYIPGTKMVFPGLKKPQERADLISYLKESTAS

SEQ ID NO: 5057 - protein, 112 aa, Musa acuminata
MASFAEAPPGDPKAGEKIFKTKCAQCHTVDKGAGHKQGPNLNGLFGRQSGTTPGYSYSSANKNMAVIWEESTLYDYLLNPKKYIPGTKMVFPGLKKPQERADLIAYLKQSTA

SEQ ID NO: 5058 - protein, 113 aa, Catharanthus roseus
MASFAEAPPGNPKAGEKIFKTKCAQCHTVEKGAGHKQGPNLNGLFGRQSGTTPGYSYSAANKNMAVIWEEKTLYDYLLNPKKYIPGTKMVFPGLKKPQERADLIAYLKEATSQ

SEQ ID NO: 5059 - protein, 112 aa, Cleome spinosa
MASFDEAPPGNSKAGEKIFRTKCAQCHTVDKGAGHKQGPNLNGLFGRQSGTTPGYSYSAANKNMAVMWEEKTLYDYLLNPKKYIPGTKMVFPGLKKPQERADLIAYLKEATA

SEQ ID NO: 5060 - protein, 112 aa, Gossypium hirsutum
MASFEQAPPGNAKAGEKIFKTKCAQCHTVDKGAGHKQGPNLNGLFGRQSGTTAGYSYSAANKNMAVIWSENTLYDYLLNPKKYIPGTKMVFPGLKKPQDRADLIAYLKESTA

SEQ ID NO: 5061 - protein, 112 aa, Gossypium hirsutum
MASFEQAPPGNAKAGEKIFKTKCAQCHTVDKGAGHKQGPNLNGLFGRQSGTTAGYSYSAANKNMAVVWSENTLYDYLLNPKKYIPGTKMVFPGLKKPQDRADLIAYLKESTA

SEQ ID NO: 5062 - protein, 113 aa, Cynodon dactylon
MASFSEAPPGNPKAGEKIFKTKCAQCHTVDKGAGHKQGPNLNGLFGRQSGTTPGYSYSAANKNMAVIWEENTLYDYLLNPKKYIPGTKMVFPGLKKPQDRADLIAYLKEATSS

SEQ ID NO: 5063 - protein, 112 aa, Euphorbia peplus
MASFDQAPPGDPKAGEKIFKTKCAQCHTVEKGAGHKQGPNLNGLFGRQSGTTAGYSYSAANKNMAVTWQENTLYDYLLNPKKYIPGTKMVFPGLKKPQDRADLIAYLKEATA

SEQ ID NO: 5064 - protein, 112 aa, Zea mays
MASFSEAPPGNPKAGEKIFKTKCAQCHTVDKGAGHKQGPNLNGLFGRQSGTTAGYSYSAGNKNKAVVWEEDTLYEYLLNPKKYIPGTKMVFPGLKKPQERADLIAYLKEATA

SEQ ID NO: 5065 - protein, 112 aa, Zea mays
MASFSEAPPGNPKAGEKIFKTKCAQCHTVEKGAGHKQGPNLNGLFGRQSGTTTGYSYSAGNKNKAVIWEENTLYDYLLNPKKYIPGTKMVFPGLKKPQERADLIAYLKEATA

SEQ ID NO: 5066 - protein, 112 aa, Zea mays
MASFSEAPPGNPTAGEKIFKTKCAQCHTVDKGAGHKQGPNLNGLFGRQSGTTPGYSYSSANKNMAVIWEENTLYDYLLNPKKYIPGTKMVFPGLKKPQERADLIAYLKNATV

SEQ ID NO: 5067 - protein, 112 aa, Petunia hybrida
MATFEEAPAGNPKAGEKIFKTKCAQCHTVDKGAGHKQGPNLNGLFGRQSGTTPGYSYSAANKNMAVIWGENTLYEYLLNPKKYIPGTKMVFPGLKKPQERADLIAYLKESTA

SEQ ID NO: 5068 - protein, 112 aa, Plantago ovata
MASFAEAPPGNKAAGEKIFKTKCAQCHTVDKGAGHKQGPNLNGLFGRQSGTTPGYSYSAANKNMAVMWEEKTLYDYLLNPKKYIPGTKMVFPGLKKPQERADLIAYLKESTA

SEQ ID NO: 5069 - protein, 112 aa, Plantago ovata
MASFDEAPPGNKAAGEKIFKTKCAQCHTVDKGAGHKQGPNLNGLFGRQSGTTAGYSYSAANKNKAVNWEENTLYDYLLNPKKYIPGTKMVFPGLKKPQDRADLIAYLKESTA

SEQ ID NO: 5070 - protein, 112 aa, Raphanus sativus
MASFDEAPPGNPKAGEKIFRTNCAQCHTVDKGAGHKQGPNLNGLFGRQSGTTAGYSYSAANKNKAVEWEEKTLYDYLLNPKKYIPGTKMVFPGLKKPQERADLIAYLKEATA

SEQ ID NO: 5071 - protein, 112 aa, Sorghum bicolor
MASFSEAPPGNPTAGEKIFKTKCAQCHTVDKGAGHKQGPNLNGLFGRQSGTTPGYSYSTANKSMAVIWEENTLYDYLLNPKKYIPGTKMVFPGLKKPQERADLIAYLKNATA

SEQ ID NO: 5072 - protein, 112 aa, Saccharum officinarum
MASFSEAPPGNPTAGEKIFKTKCAQCHTVDKGAGHKQGPNLSGLFGRQSGTTPGYSYSSANKNMAVIWEENTLYDYLLNPKKYIPGTKMVFPGLKKPQERADLIAYLKNATA

SEQ ID NO: 5073 - protein, 112 aa, Triticum aestivum
MASFSEAPPGNPAAGEKIFKTKCAQCHTVDKGAGHKQGPNLNGLFGRQSGTTAGYSYSTANKSMAVVWEEKTLYDYLLNPKKYIPGTKMVFPGLKKPQERADLIAYLKSATA

SEQ ID NO: 5074 - protein, 780 aa, Gossypium raimondii
PKPNNNNCRMPENFSLKETKPNIGGGRVSGGREKLTSSFDLVEVTHFLFVRVVKARDLACSNATVGGGVCHTFVEIKIGKYKGSTKYLEMNKRNPEWNQVFAFTKDRIQSLSVEITVREKEFVNDEFIGKIAIDMSDIPTRVPPDSPLAPQWYKLESEANSSVGELMMILWFGTQADEVFIDAWHSDVASVSGDSITNTRSKVYLSPRLWYLRINIIEAQDLVVPGDKNRNPEVYVKAALGNVKLRTRVSADKSLNPRWNEDLMFVAVEPFYDHLVLTVVDKNNEEEFSLGRCMVHLSEAYIRWLPEPVGAKWYNLEGGGDVVEELKFASKLNMRISLDGGYHVFDESIDCSSDYRATFKGLWPPAIGVLELGIIGASVLVPMKSRDGRETTDAYCVAKYGPKWVRTRTVVNSFSPKWNEQYTWEVYDPYTVLIIGIFDNCHLNGEKGPNPKDPSIGKLRIRLSTLSTNRVYTYSYPLIALQPSGVKKMGEIQLALRFTSPSYTSLLAAYARPLFPKMHYIHPLSVYQLDSLRQQAIGILCSRLSSAEPPLRTEVTGFMLDAGYQLWSPRKAKANTERLMDAVHVITEAWKWFDTIKKWNNPAANVLVIVLYLVVVFYPSLVLPTLLIYCFLIGIWQYRKRPRDPTHVDIKLSLADSTNADEWDEEFDTFPSSKQGEVLRMRYDRLRSMAGKVMVMVGDLATQGERLTALWSWQDPVASAIFLALCVMAAVVFCSGLVPPRCILVMVGMFVMRPPSFGIGIPCAPQNVFGRLPTKADCML

SEQ ID NO: 5075 - protein, 325 aa, Ricinus communis
MATCLRALPITTCSIPSSSSSASSNSQSLKRRNLRINCSSSKIPMPPINPKDPFLSKLASIAANSPDSLLDRPITSDTPPFLDLFDSPKLMATPAQVERSVSYNEHRPRKPPPDLPSLLLHGRIVYIGMPLVPAVTELVVAELMYLQWMDPKEPIYLYINSTGTTRDDGETVGMETEGFAIYDSMMQLKNEIHTVAVGAAIGQACLLLAAGTKGKRFMMPHAKAMIQQPKVPSSGLMAASDVLIRAKEAVTNRDTLVELLAKHTENSVETVANAMKRPFYMDSRRAKEFGVIDKILWRGQEKIMADVVTPEEWDKMAGIKIADPF

SEQ ID NO: 5076 - protein, 93 aa, Saccharum officinarum
MASFSEAPPGNPKAGEKIFKTKCAQCHTVDKGAGHKQGPNLNGLFGRQSGTTAGYSYSAGNKNKAVVWEENTLYEYLLNPKKSFLEPRWSSLG

SEQ ID NO: 5077 - protein, 114 aa, Aristolochia fimbriata
MASFAEAPPGNAKAGEKIFKTKCAQCHTVDKGAGHKQGPNLNGLFGRQSGTTPGYSYSAANKNMAVIWQESTLYDYLLNPKKYIPGTKMVFPGLKKPQERADLIAYLKEGTAEP

SEQ ID NO: 5078 - protein, 112 aa, Unknown
  Sequence found in Organisms: Brassica napus, Brassica juncea, Brassica rapa, Raphanus sativus, Thellungiella halophila, Eutrema halophilum
MASFDEAPPGNPKAGEKIFRTKCAQCHTVDKGAGHKQGPNLNGLFGRQSGTTPGYSYSAANKNMAVMWEEKTLYDYLLNPKKYIPGTKMVFPGLKKPQDRADLIAYLKEGTA

SEQ ID NO: 5079 - protein, 112 aa, Unknown
  Sequence found in Organisms: Brassica napus, Brassica oleracea, Brassica rapa
MASFDEAPPGNSKAGEKIFRTKCAQCHTVDKGAGHKQGPNLNGLFGRQSGTTAGYSYSAANKNKAVEWEEKTLYDYLLNPKKYIPGTKMVFPGLKKPQDRADLIAYLKEATA

SEQ ID NO: 5080 - protein, 112 aa, Musa acuminata
MASFAEAPPGDPKAGEKIFKTKCAQCHTVDKGAGHKQGPNLNGLFGRQSGTTAGYSYSAANKNMAVVWEETTLYDYLLNPKKYIPGTKMVFPGLKKAQERADLISYLKQSTA

SEQ ID NO: 5081 - protein, 112 aa, Fagus grandifolia
MATFAEAPPGNPKAGEKIFKTKCAQCHTVDKGAGHKQGPNLNGLFGRQSGTTPGYSYSAANKNKAVDWEEKTLYDYLLNPKKYIPGTKMVFPGLKKPQDRADLIAYLKESTA

SEQ ID NO: 5082 - protein, 112 aa, Linum usitatissimum
MATFNEAPPGNPDAGAKIFKTKCAQCHTVDKGAGHKQGPNLNGLFGRQSGTTPGYSYSAANKNMAVNWAENTLYDYLLNPKKYIPGTKMVFPGLKKPQERADLIAYLKQSTA

SEQ ID NO: 5083 - protein, 112 aa, Gossypium raimondii
MASFEQAPPGDAKAGEKIFKTKCAQCHTVDKGAGHKQGPNLNGLFGRQSGTTPGYSYSAANKNMAVIWGENTLYDYLLNPKKYIPGTKMVFPGLKKPQDRADLIAYLKESTA

SEQ ID NO: 5084 - protein, 112 aa, Carpinus betulus
MASFDQAPPGDPKVGEKIFKTKCAQCHTVDKGAGHKQGPNLNGLFGRQSGTTPGYSYSTANKNMAVNWEEKTLYDYLLNPKKYIPGTKMVFPGLKKPQERADLIAYLKQATA

SEQ ID NO: 5085 - protein, 113 aa, Elaeis guineensis
MASFAEAPPGNAKAGEKIFKTKCAQCHTVEKGAGHKQGPNLNGLFGRQSGTTPGYSYSAANKNMAVTWEESTLYDYLLNPKKYIPGTKMVFPGLKKPQERADLIAYLKESTAP

SEQ ID NO: 5086 - protein, 112 aa, Papaver somniferum
MASFEQAPPGDAKAGEKIFKTKCAQCHTVDKGAGHKQGPNLNGLFGRQSGTTAGYSYSSANKNMAVNWEEKTLYDYLLNPKKYIPGTKMVFPGLKKPQERADLIAYLKQSTA

SEQ ID NO: 5087 - protein, 112 aa, Secale cereale
MASFSEAPPGNPASGEKIFKTKCAQCHTVDKGAGHKQGPNLNGLFGRQSGTTPGYSYSTANKLMAVNWEEKTLYDYLLNPKKYIPGTKMVFPGLKKPQERADLIAYLKGATA

SEQ ID NO: 5088 - protein, 112 aa, Unknown
  Sequence found in Organisms: Cucurbita pepo, Citrullus lanatus
MASFDEAPPGNSKAGEKIFKTKCAQCHTVDKGAGHKQGPNLNGLFGRQSGTTPGYSYSAANKNMAVIWEEKTLYDYLLNPKKYIPGTKMVFPGLKKPQDRADLIAYLKESTA

SEQ ID NO: 5089 - protein, 112 aa, Phaseolus vulgaris
MASFDEAPPGNSKNGEKIFKTKCAQCHTVDKGAGHKQGPNLNGLFGRQSGTTAGYSYSSANKNRAVTWEENTLYDYLLNPKKYIPGTKMVFPGLKKPQDRADLIAYLKESTA

SEQ ID NO: 5090 - protein, 113 aa, Theobroma cacao
MASFEEAPPGNSKAGEKIFKTKCAQCHTVEKGAGHKQGPNLNGLFGRQSGTTPGYSYSAANKNMAVNWEEKTLYDYLLNPKKYIPGTKMVFPGLKKPQERADLIAYLKESTAP

SEQ ID NO: 5091 - protein, 112 aa, Ricinus communis
MASFDQAPPGDVKAGEKIFKTKCAQCHTVEKGAGHKQGPNLNGLFGRQSGTTAGYSYSAANKNMAVQWGENTLYDYLLNPKKYIPGTKMVFPGLKKPQDRADLIAYLKQATA

SEQ ID NO: 5092 - protein, 112 aa, Cleome spinosa
MASFDEAPPGNSKAGEKIFRTKCAQCHTVEKGAGHKQGPNLNGLFGRQSGTTPGYSYSAANKNMAVIWEEKTLYDYLLNPKKYIPGTKMVFPGLKKPQERADLIAYLKEATA

SEQ ID NO: 5093 - protein, 113 aa, Cynodon dactylon
MASFSEAPPGNPKAGEKIFKTKCAQCHTVDKGAGHKQGPNLNGLFGRQSGTTPGYSYSAANKNRAVIWEENTLYDYLLNPKKYIPGTKMVFPGLKKPQERVDLIAYLKEATSS

SEQ ID NO: 5094 - protein, 113 aa, Euonymus alatus
MASFDEAPPGNPKSGEKIFKTKCAQCHTVDKGAGHKQGPNLNGLFGRQSGTTPGYSYSAANKNMAVNWEEKTLYDYLLNPKKYIPGTKMVFPGLKKPQDRADLIAYLKESTAS

SEQ ID NO: 5095 - protein, 112 aa, Vitis vinifera
MASFDEAPPGNPAAGEKIFKTKCAQCHTVDKGAGHKQGPNLNGLFGRQSGTTPGYSYSAANKNMAVIWEEKTLYDYLLNPKKYIPGTKMVFPGLKKPQDRADLIAYLKQATA

SEQ ID NO: 5096 - protein, 112 aa, Ipomoea nil
MASFAEAPPGDVKAGEKIFRTKCAQCHTVDKGAGHKQGPNLNGLFGRQSGTTPGYSYSAANKNMAVIWQEKTLYDYLLNPKKYIPGTKMVFPGLKKPQERADLIAYLKESTA

SEQ ID NO: 5097 - protein, 112 aa, Jatropha curcas
MATFEQAPPGDVKAGEKIFKTKCAQCHTVEKGAGHKQGPNLNGLFGRQSGTTAGYSYSAANKNMAVIWGENTLYDYLLNPKKYIPGTKMVFPGLKKPQDRADLIAYLKEATA

SEQ ID NO: 5098 - protein, 112 aa, Lactuca sativa
MASFAEAPAGNATAGEKIFKTKCAQCHTVEKGAGHKQGPNLNGLFGRQSGTTAGYSYSAANKNKAVNWEENTLYDYLLNPKKYIPGTKMVFPGLKKPQERADLIAYLKASTA

SEQ ID NO: 5099 - protein, 113 aa, Lotus japonicus
MASFDEAPPGNSKSGEKIFKLKCAQCHTVEKGAGHKQGPNLNGLFGRQSGTTAGYSYSAANKNMAVNWEEKTLYDYLLNPKKYIPGTKMVFPGLKKPQERADLIAYLKEATAQ

SEQ ID NO: 5100 - protein, 112 aa, Cucumis melo
MASFDEAPPGNSKTGEKIFKTKCAQCHTVDKGAGHKQGPNLNGLFGRQSGTTPGYSYSAANKNMAVIWEEKTLYDYLLNPKKYIPGTKMVFPGLKKPQERADLIAYLKESTA

SEQ ID NO: 5101 - protein, 112 aa, Carica papaya
MASFEQAPPGDAKAGEKIFKTKCAQCHTVDKGAGHKQGPNLNGLFGRQSGTTPGYSYSAANKNMAVIWGENTLYDYLLNPKKYIPGTKMVFPGLKKPQDRADLIAYLKGATA

SEQ ID NO: 5102 - protein, 112 aa, Lippia dulcis
MASFGEAPPGDVKSGEKIFKTKCAQCHTVDKGAGHKQGPNLNGLLGRQSGTTPGYSYSAANKNMAVQWGENTLYDYLLNPKKYIPGTKMVFPGLKKPKERADLIAYLKEATA

SEQ ID NO: 5103 - protein, 112 aa, Cajanus cajan
MASFDEAPPGNPKAGEKIFRTKCAQCHTVDKGAGHKQGPNLNGLFGRQSGTTPGYSYSAANKNMAVIWEEKTLYDYLLNPKKYIPGTKMVFPGLKKPQDRADLIAYLKESTA

SEQ ID NO: 5104 - protein, 113 aa, Ananas comosus
MATFAEAPPGNPKAGEKIFKTKCAQCHTVEKGAGHKQGPNLNGLFGRQSGTTPGYSYSTANKNMAVIWEENTLYEYLLNPKKYIPGTKMVFPGLKKPQERADLIAYLKEATKP

SEQ ID NO: 5105 - protein, 112 aa, Primula obconica
MASFAEAPAGDPKTGEKIFRTKCAQCHTVDKGAGHKQGPNLNGLFGRQSGTTAGYSYSSANKNRAVTWGENTLYDYLLNPKKYIPGTKMVFPGLKKPQERADLIAYLKASTA

SEQ ID NO: 5106 - protein, 112 aa, Raphanus sativus
MASFDEAPPGNSKAGEKIFRTKCAQCHTVDKGAGHKQGPNLNGLFGRQSGTTAGYSYSAANKNKAVEWEEKTLYDYLLNPKKYIPGTKMVFPGLKKPQERADLITYLKEATA

SEQ ID NO: 5107 - protein, 112 aa, Rhizophora mangle
MASFQEAPPGNEKAGEKIFKTKCAQCHTVEKGAGHKQGPNLNGLFGRQSGTTAGYSYSAANKNMAVTWEENTLYNYLLNPKKYIPGTKMVFPGLKKPQERADLIAYLKQSTA

SEQ ID NO: 5108 - protein, 112 aa, Salvia sclarea
MASFAEAPPGNKAVGEKIFKTKCAQCHTVDKGAGHKQGPNLNGLFGRQSGTTAGYSYSAANKNMAVIWEEKTLYDYLLNPKKYIPGTKMVFPGLKKPQDRADLIAYLKESTA

SEQ ID NO: 5109 - protein, 112 aa, Glycine max
MASFDEAPPGNSKNGEKIFKTKCAQCHTVDKGAGHKQGPNLNGLFGRQSGTTPGYSYSTANKNMAVIWEEKTLYDYLLNPKKYIPGTKMVFPGLKKPQERADLIAYLKESTA

SEQ ID NO: 5110 - protein, 112 aa, Glycine max
MASFEEAPPGNSKNGEKIFKTKCAQCHTVDKGAGHKQGPNLNGLFGRQSGTTPGYSYSTANKNMAVIWEEKTLYDYLLNPKKYIPGTKMVFPGLKKPQERADLIAYLKESTA

SEQ ID NO: 5111 - protein, 112 aa, Panicum virgatum
MASFSEAPPGNPKAGEKIFKTKCAQCHTVEKGAGHKQGPNLNGLFGRQSGTTAGYSYSAGNKNKAVVWEENTLYEYLLNPKKYIPGTKMVFPGLKKPQERADLIAYLKEATT

SEQ ID NO: 5112 - protein, 112 aa, Tabernaemontana elegans
MASFEQAPPGDVKAGEKIFKTKCAQCHTVDKGAGHKQGPNLNGLFGRQSGTTPGYSYSAANKNMAVIWGENTLYDYLLNPKKYIPGTKMVFPGLKKPQDRADLIAYLKESTA

SEQ ID NO: 5113 - protein, 112 aa, Nicotiana tabacum
MATFEEAPAGNPKAGEKIFKTKCAQCHTVDKGAGHKQGPNLNGLFGRQSGTTPGYSYSAANKNMAVIWGENTLYEYLLNPKKYIPGTKMVFPGLKKPQDRADLIAYLKESTA

SEQ ID NO: 5114 - protein, 112 aa, Nicotiana tabacum
  misc_feature (11)..(11): Xaa can be any naturally occurring amino acid
MATFEEAPAGXPKAGEKIFKTKCAQCHTVDKGAGHKQGPNLNGLFGRQSGTTPGYSYSAANKNMAVIWGENTLYEYLLNPKKYIPGTKMVFPGLKKPQERADLIAYLKESTA

SEQ ID NO: 5115 - protein, 113 aa, Rosa hybrid cultivar
MASFAEAPPGDAKAGEKIFKTKCAQCHTVDKGAGHKQGPNLNGLFGRQSGTTPGYSYSAANKNMAVNWEEKTLYDYLLNPKKYIPGTKMVFPGLKKPKERADLIAYLKESTAS

SEQ ID NO: 5116 - protein, 65 aa, Phalaenopsis aphrodite
MASFSEAPPGDPKAGEKIFKTKCAQCHTVEKGAGHKQGPNLNGLFGRQSGTTAGYSYSTANKTWL

SEQ ID NO: 5117 - protein, 358 aa, Brassica juncea
MSVRTILPPAVLLILIAASTAENIEFDESNPIRMVSDRLREVEQSVVQILGQSRHVLSFARFTHRYGKRYESAEEMKLRFSIFKENLDLIRSTNKKGLSYKLGLNQFADMTWQEFQRTKLGAAQNCSATLKGSHKLTGEALPETKDWREDGIVSPVKDQGGCGSCWTFSTTGALEAAYHQAFGKGISLSEQQLVDCAGAFNNYGCNGGLPSQAFEYIKSNGGLDTEEAYPYTGEDGTCKYSAENVGVQVLDSVNITLGAEDELKHAVGLVRPVSIAFEVIHSFRLYKSGVYSDSHCGQTPMDVNHAVLAVGYGIEDGVPYWLIKNSWGADWGDKGYFKMEMGKNMCGIATCASYPVVA

SEQ ID NO: 5118 - protein, 60 aa, Brassica napus
MASFDEAPPGNPKAGEKIFRTKCAQCHTVDKGAGHKQGPNLNGLFGRQIRNNARVFLLCC

SEQ ID NO: 5119 - protein, 106 aa, Raphanus sativus
  misc_feature (103)..(103): Xaa can be any naturally occurring amino acid
MASFDEAPPGNSKAGEKIFRTKCAQCHTVDKGAGHKQGPNLNGLFGRQSGTTAGYSYLLLTRTKLSNGKRRPCTITCSTPRSTFLERRWSSLGSRSHKNVLIXLPT

SEQ ID NO: 5120 - protein, 113 aa, Vaccinium corymbosum
MASFDQAPPGDAKSGEKIFRTKCAQCHTVDKGAGHKQGPNLNGLFGRQSGTTPGYSYSAANKNMAVNWGENTLYDYLLNPKKYIPGTKMVFPGLKKPQERADLIAYLKEATSS

SEQ ID NO: 5121 - protein, 113 aa, Elaeis guineensis
MASFAEAPPGEPKAGEKIFKTKCAQCHTVDKGAGHKQGPNLNGLIGRQSGTTPGYSYSAANKNMAVIWEESTLYDYLLNPKKYIPGTKMVFPGLKKPQERADLIAYLKQSTAP

SEQ ID NO: 5122 - protein, 113 aa, Elaeis guineensis
MATFSEAPPGNPKSGEKIFKTKCAQCHTVQKGAGHKQGPNLNGLFGRQSGTTPGYSYSTANKNMAVIWGESTLYDYLLNPKKYIPGTKMVFPGLKKPQERADLIAYLKESTAS

SEQ ID NO: 5123 - protein, 113 aa, Persea americana
MATFAEAPAGNEKSGEKIFRTKCAQCHTVDKGAGHKQGPNLNGLFGRQSGTTAGYSYSTANKNMAVIWGESTLYDYLLNPKKYIPGTKMVFPGLKKPQERADLIAYLKEATSS

SEQ ID NO: 5124 - protein, 113 aa, Brachypodium distachyon
MASFSEAPPGNPKAGEKIFKTKCAQCHTVDKGAGHKQGPNLNGLFGRQSGTTPGYSYSSANKNMAVIWEEKTLYDYLLNPKKYIPGTKMVFPGLKKPQDRADLISYLKEATSS

SEQ ID NO: 5125 - protein, 113 aa, Coffea canephora
MATFEQAPPGDPKGGEKIFKTKCAQCHTVDKGAGHKQGPNLNGLFGRQSGTTAGYSYSAANKNMAVIWGENTLYDYLLNPKKYIPGTKMVFPGLKKPQERADLIAYLKHATSA

SEQ ID NO: 5126 - protein, 114 aa, Gossypium hirsutum
MASFAEAPPGNAKAGEKIFKTKCAQFHTVDKGAGHKQGPNLNGLFGRQSGTTPGYSYSAANKNMAVIWQESTLYDYLLNPKKYIPGTKMVFPGLKKPQERADLIAYLKEGTAEP

SEQ ID NO: 5127 - protein, 113 aa, Eucalyptus grandis
MASFAEAPPGNPKVGEKIFKTKCAQCHTVEKGAGHKQGPNLNGLFGRQSGTTAGYSYSAANKNMAVNWEEKTLYDYLLNPKKYIPGTKMVFPGLKKPQDRADLIAFLKQSTAS

SEQ ID NO: 5128 - protein, 113 aa, Elaeis guineensis
  misc_feature (75)..(75): Xaa can be any naturally occurring amino acid
MASFAEAPPGNAKAGEKIFKTKCAQCHTVEKGAGHKQGPNLNGLFGRQSGTTPGYSYSAANKNMAVTWEESTLYXYLLNPKKYIPGTKMVFPGLKKPQERADLIAYLKESTAP

SEQ ID NO: 5129 - protein, 113 aa, Lippia dulcis
MASFAEAPAGNKAAGEKIFKTKCAQCHTVDKGAGHKQGPNLNGLFGRQSGTTPGYSYSAANKNMAVTWEEKTLYDYLLNPKKYIPGTKMVFPGLKKPQERADLIAYLKESTAN

SEQ ID NO: 5130 - protein, 112 aa, Unknown
  Sequence found in Organisms: Brassica napus, Brassica juncea, Brassica rapa
MASFDEAPPGNSKAGEKIFRTKCAQCHTVDKGAGHKQGPNLNGLFGRQSGTTAGYSYSAANKNKAVEWEEKTLYDYLLNPKKYIPGTKMVFPGLKKPQDRADLIAYLKESTA

SEQ ID NO: 5131 - protein, 112 aa, Cannabis sativa
MASFDEAPPGNSKTGEKIFRTKCAQCHTVDKGAGHKQGPNLNGLFGRQSGTTAGYSYSAANKNMAVTWEEKTLYDYLLNPKKYIPGTKMVFPGLKKPQDRADLIAYLKESTA

SEQ ID NO: 5132 - protein, 112 aa, Unknown
  Sequence found in Organisms: Centaurea maculosa, Cirsium arvense
MASFAEAPAGNPTAGEKIFKTKCAQCHTVEKGSGHKQGPNLNGLFGRQSGTTAGYSYSAANKNKAVTWEENTLYDYLLNPKKYIPGTKMVFPGLKKPQERADLIAYLKSSTA

SEQ ID NO: 5133 - protein, 112 aa, Gossypium hirsutum
MASFEQAPPGDAKAGEKIFKTKCAQCHTVDKGAGHKQGPNLNGLFRRQSGTTPGYSYSAANKNMAVIWGENTLYDYLLNPKKYIPGTKMVFPGLKKPQDRADLIAYLKESTA

SEQ ID NO: 5134 - protein, 112 aa, Flaveria ramosissima
MASFAEAPAGNPAAGEKIFKTKCAQCHTVEKGAGHKQGPNLNGLFGRQSGTTAGYSYSAGNKNKAVIWEENTLYDYLLNPKKYIPGTKMVFPGLKKPQERADLIAYLKASTA

SEQ ID NO: 5135 - protein, 112 aa, Fraxinus spp
MASFNEAPPGNVKSGEKIFKTKCAQCHTVEKGAGHKQGPNLSGLFGRQSGTTPGYSYSAANKNMAVIWGENALYDYLLNPKKYIPGTKMVFPGLKKPQDRADLIAYLKEATA

SEQ ID NO: 5136 - protein, 112 aa, Unknown
  Sequence found in Organisms: Arabidopsis thaliana, Arabidopsis lyrata
MASFDEAPPGNPKAGEKIFRTKCAQCHTVEKGAGHKQGPNLNGLFGRQSGTTPGYSYSAANKSMAVNWEEKTLYDYLLNPKKYIPGTKMVFPGLKKPQDRADLIAYLKEGTA

SEQ ID NO: 5137 - protein, 112 aa, Hordeum vulgare
MASFSEAPPGNPASGEKIFKTKCAQCHTVDKGAGHKQGPNLNGLFGRQSGTTPGYSYSTANKTMAVVWEEKTLYDYLLNPKKYIPGTKMVFPGLKKPQERADLIAYLKSATA

SEQ ID NO: 5138 - protein, 112 aa, Theobroma cacao
MASFDQAPPGNAKAGEKIFKTKCAQCHTVEKGAGHKQGPNLNGLFGRQSGTTSGYSYSAANKNMAVIWEENTLYDYLLNPKKYIPGTKMVFPGLKKPQERVDLIAYLKESTA

SEQ ID NO: 5139 - protein, 112 aa, Brassica napus
MATFDEAPPGNPKAGEKIFRTKCAQCHTVDKGAGHKQGPNLNGLFGRQSGTTPGYSYSAANKNMAVMWEEKTLYDYLLNPKKYIPGTKMVFPGLKKPQDRADLIAYLKEGTA

SEQ ID NO: 5140 - protein, 112 aa, Catharanthus roseus
MATFEQAPAGDPKAGEKIFKTKCAQCHTVDKGAGHKQGPNLNGLFGRQSGTTPGYSYSAANKNMAVIWGENTLYDYLLNPKKYIPGTKMVFPGLKKPQERADLIAFLKESTA

SEQ ID NO: 5141 - protein, 112 aa, Chelidonium majus
MASFEQAPPGDAKAGEKIFKTKCAQCHTVDKGAGHKQGPNLNGLFGRQSGTTAGYSYSSANKNMAVTWEEKTLYDYLLNPKKYIPGTKMVFPGLKKPQERADLIAYLKQSTA

SEQ ID NO: 5142 - protein, 112 aa, Cichorium intybus
MASFEQAPGGDAKVGEKIFKTKCAQCHTVEKGAGHKQGPNLNGLFGRQSGTTAGYSYSAANKNMAVNWGENTLYDYLLNPKKYIPGTKMVFPGLKKPQERADLIAYLKQSTA

SEQ ID NO: 5143 - protein, 112 aa, Unknown
  Sequence found in Organisms: Citrus sinensis, Citrus clementina, Citrus sinensis
MASFDEAPPGNAKAGEKIFKTKCAQCHTVEKGAGHKQGPNLNGLFGRQSGTTPGYSYSAANKNMAVNWEEKTLYDYLLNPKKYIPGTKMVFPGLKKPQDRADLIAYLKQSTA

SEQ ID NO: 5144 - protein, 112 aa, Unknown
  Sequence found in Organisms: Citrus clementina, Citrus sinensis
MASFEEAPPGNPKAGEKIFKTKCAQCHTVVKGAGHKQGPNLNGLFGRQSGTTPGYSYSAANKGMAVIWEEKTLYDYLLNPKKYIPGTKMVFPGLKKPQDRADLIAYLKESTA

SEQ ID NO: 5145 - protein, 112 aa, Cleome gynandra
MATFDEAPPGNPKAGEKIFKIKCAQCHTVEKGAGHKQGPNLNGLFGRQSGTTPGYSYSAANKNMAVIWEEKTLYDYLLNPKKYIPGTKMVFPGLKKPQERADLISYLKEATA

SEQ ID NO: 5146 - protein, 112 aa, Curcuma longa
MASFAEAPPGDAKSGEKIFKTKCAQCHTVEKGAGHKQGPNLNGLFGRQSGTTAGYSYSTANKNMAVIWEESTLYDYLLNPKKYIPGTKMVFPGLKKPQERADLIAYLKSSTA

SEQ ID NO: 5147 - protein, 112 aa, Vitis vinifera
MATFADAPAGNAAAGEKIFRTKCAQCHTVDKGAGHKQGPNLNGLFGRQSGTTAGYSYSAANKNMAVAWGENTLYDYLLNPKKYIPGTKMVFPGLKKPQDRADLIAYLKESTA

SEQ ID NO: 5148 - protein, 112 aa, Ipomoea batatas
MASFEQAPPGDARAGEKIFKMKCAQCHTVDKGAGHKQGPNLNGLFGRQSGTTPGYSYSAANKNMAVIWGENTLYDYLLNPKKYIPGTKMVFPGLKKPQERADLIAYLKESTA

SEQ ID NO: 5149 - protein, 112 aa, Ipomoea nil
MASFNEAPPGDAKSGEKIFKMKCAQCHTVDKGAGHKQGPNLNGLFGRQSGTTPGYSYSAANKNMAVTWGENTLYDYLLNPKKYIPGTKMVFPGLKKPQDRADLIAYLKESTA

SEQ ID NO: 5150 - protein, 112 aa, Mimulus guttatus
MASFDEAPPGDVKSGDKIFRTKCAQCHTVDKGAGHKQGPNLNGLFGRQSGTTPGYSYSAANKSMAVNWGENTLYDYLLNPKKYIPGTKMVFPGLKKPKERADLIAYLKEATA

SEQ ID NO: 5151 - protein, 112 aa, Tropaeolum majus
MASFNEAPPGNSSVGEKIFKTKCAQCHTVEKGAGHKQGPNLNGLFGRQSGTTAGYSYSTANKSMAVTWGENTLYDYLLNPKKYIPGTKMVFPGLKKPQDRADLIAYLKESTA

SEQ ID NO: 5152 - protein, 112 aa, Primula obconica
MASYAEAPAGNEKTGEKIFRTKCAQCHTVDKGAGHKQGPNLNGLFGRQSGTTAGYSYSSANKNMAVTWGENTLYDYLLNPKKYIPGTKMVFPGLKKPQDRADLIAYLKASTA

SEQ ID NO: 5153 - protein, 112 aa, Prunus persica
MASFAEAPPGDAKAGEKIFRTKCAQCHTVDKGAGHKQGPNLNGLFGRQSGTTPGYSYSAANKNMAVNWEEKTLYDYLLNPKKYIPGTKMVFPGLKKPQDRADLIAYLKQSTA

SEQ ID NO: 5154 - protein, 112 aa, Nicotiana tabacum
MASFAEAPPGNEAAGAKIFKTKCAQCHTVEQGAGHKQGPNLNGLFGRQSGTTAGYSYSAANKNMAVMWEEKTLYDYLLNPKKYIPGTKMVFPGLKKPQERADLIAYLKSATA

SEQ ID NO: 5155 - protein, 112 aa, Triticum aestivum
MASFSEAPPGNPAAGEKIFKTKCAQCHTVDKGAGHKQGPNLNGLFGRKSGTTTGYSYSTANKSMAVVWEEKTLYDYLLNPKKYIPGTKMVFPGLKKPQERADLIAYLKSATA

SEQ ID NO: 5156 - protein, 67 aa, Brassica rapa
EQNKNKKSQGHRYSYCRSEMASFDEAPPGNPKAGEKIFRTKCAQCHTVDKGAGHKQGPNLNGLFGRQ

SEQ ID NO: 5157 - protein, 323 aa, Brassica napus
MRSLTLTLRSSSLPFTFTSSSFRRFHFLKPCSSSLKQTKKQQQSLRRSPPPSTAPPPKSLRWFFNPKSSDDDDAKSPKAESDEGSGGDAAIKGTILAGVLLIGTVGGFAGVGYVYRDQINTFLTQFSTFIEGYGPAGYALFIAVYAGLEILAIPALPLTMSAGLLFGSLVGTIIVSISGTMAASVAFLIARYFARERILKLVEGNKKFLAIDKAIGENGFRVVTLLRLSPLLPFSLGNYLYGLTSVKFVPYVLGSWLGMLPGSWAYVSAGAFGRAIIQEESAVGLPGGNGQLLTLGLGLLVTALAATYVTGLAKDAIKDIDDE

SEQ ID NO: 5158 - protein, 67 aa, Secale cereale
PPATRIAQGSPTLPSPATVRAGSAAAAMASFSEAPPGNPRPARRSSRPSAPSATPSTRAPATSKGLT

SEQ ID NO: 5159 - protein, 279 aa, Brassica juncea
LSIEPLLRLAGGVSLEVKSVRYTRGSFLCPGGQPFPHRNFSEEVSVLDGHFAKMGLSSVAYLMGDDDETKKWHVYSASAPAKNSNGDNNVYTLEMCMTGLDKDKASVFFKNESSSAGSMTDNSGIRKILPQSQICDFEFEPCGYSMNSVEGDAISTIHVTPEDGFSYASFEAVGYDFTTMDLSQLVSRVLTCFEPKQFSVAVHSSVAQKSYDHSGLSVDLEDYGCRETTVESLGEERGTVMYQRFEKLGMYCGSPRSTLKCEWSSNSSCTSEDEKEEGI

SEQ ID NO: 5160 - protein, 216 aa, Tabernaemontana elegans
MAAPPARARADYDYLIKLLLIGDSGVGKSCLLLRFSDGSFTTSFITTIGIDFKIRTIELDGKRIKLQIWDTAGQERFRTITTAYYRGAMGILLVYDVTDESSFNNIRNWIRNIEQHASDNVNKILVGNKADMDESKRAVPTSKGQALADEYGIKFFETSAKTNLNVEEVFFSIGRDIKQRLADTDSKPEASTIKLNQPDAATGSAQITQRPTCCGS

SEQ ID NO: 5161 - protein, 238 aa, Brassica juncea
DGDAAIKGTILAGVLLIGTVGGFAGVGYVYRDQINTFLTQFSTFIEGYGPAGYALFIAVYAGLEILAIPALPLTMSAGLLFGSLVGTIIVSISGTMAASVAFLIARYFARERILKLVEGNKKFLAIDKAIGENGFRVVTLLRLSPLLPFSLGNYLYGLTSVKFVPYVLGSWLGMLPGSWAYVSAGAFGRAIIQEESAVGLPGGNGQLLTLGLGLLVTALAATYVTGLAKDAIKDIDDE

SEQ ID NO: 5162 - protein, 115 aa, Momordica charantia
MASFDEAPPGNPKAGEKIFKTKCAQCHTVDKGAGHKQGPNLNGLFGRQSGTTPGYSYSAANKNMAVIWEEKTLYDYLLNPKKYIPGTKMVFPGLKKPNERADLIAYLKESTALSE

SEQ ID NO: 5163 - protein, 113 aa, Musa acuminata
MASFAEAPPGDPNAGEKIFKTKCAQCHTVDKGAGHKQGPNLNGLFGRQSGTTPGYSYSTANKNMAVVWEESTLYDYLLNPKKYIPGTKMVFPGLKKPKERADLIAYLKQSTAS

SEQ ID NO: 5164 - protein, 113 aa, Phalaenopsis aphrodite
MASFSEAPPGDPKAGEKIFKTKCAQCHTPEKGAGHKQGPNLNGLFGRQSGTTSGYSYSTANKNMAVIWEESTLYDYLLNPKKYIPGTKMVFPGLKKPQERADLIAYLKEATNS

SEQ ID NO: 5165 - protein, 113 aa, Sesamum indicum
MASFAEAPAGNKAAGEKIFKTKCAQCHTVEKGAGHKQGPNLNGLFGRQSGTTPGYSYSAANKNMAVIWEEKTLYDYLLNPKKYIPGTKMVFPGLKKPQERADLIAYLKESTAN

SEQ ID NO: 5166 - protein, 113 aa, Bruguiera gymnorhiza
MASFAEAPPGDTKSGEKIFRTKCAQCHTVDKGAGHKQGPNLNGLFGRQSGTTAGYSYSAANKNMAVIWEEKTLYDYLLNPKKYIPGTKMVFPGLKKPQERADLIAYLKQSTAS

SEQ ID NO: 5167 - protein, 113 aa, Liriodendron tulipifera
MASFEEAPPGDPKAGEKIFKTKCAQCHTVDKGAGHKQGPNLNGLFGRQSGTTPGYSYSAANKNMAVIWEEKTLYDYLLNPKKYIPGTKMVFPGLKKPKERADLIAYLKEGTSS

SEQ ID NO: 5168 - protein, 113 aa, Nuphar advena
MASFGEAPPGDPKSGEKIFRTKCAQCHTVDKGGGHKQGPNLNGLFGRQSGTTPGYSYSAANKNMAVNWGESSLYDYLLNPKKYIPGTKMVFPGLKKPQERADLIAYLKESTAS

SEQ ID NO: 5169 - protein, 113 aa, Olea europaea
MASFAEAPPGNSKAGEKIFKTKCAQCHTVEKGAGHKQGPNLNGLFGRQSGTTPGYSYSAANKNMAVIWEEKTLYDYLLNPKKYIPGTKMVFPGLKKPQDRADLIAYLKESTSQ

SEQ ID NO: 5170 - protein, 113 aa, Populus trichocarpa
MASFAEAPPGDSKAGEKIFRTKCAQCHTVDKGAGHKQGPNLNGLFGRQSGTTTGYSYSAANKNMAVMWEEKTLYDYLLNPKKYIPGTKMVFPGLKKPQERADLIAYLKQSTAS

SEQ ID NO: 5171 - protein, 113 aa, Populus trichocarpa
MASFAEAPPGDSKVGEKVFKTKCAQCHTVDKGAGHKQGPNLNGLFGRQSGTTAGYSYSTANKNMAVTWEEKTLYDYLLNPKKYIPGTKMVFPGLKKPQERADLIAYLKQSTAS

SEQ ID NO: 5172 - protein, 113 aa, Rosa hybrid cultivar
MGPFAEAPPGDAKAGEKIFKTKCAQCHTVDKGAGHKQGPNLNGLFGRQSGTTPGYSYSAANKNMAVNWEEKTLYDYLLNPKKYIPGTKMVFPGLKKPKERADLIAYLKESTAS

SEQ ID NO: 5173 - protein, 113 aa, Thalictrum flavum
MASFDEAPPGNPKAGEKIFKTKCAQCHTVEKGAGHKQGPNLNGLFGRQSGTTPGYSYSAGNKNKAVMWEEKTLYDYLLNPKKYIPGTKMVFPGLKKPQERADLIAYLKESTAA

SEQ ID NO: 5174 - protein, 112 aa, Musa acuminata
MASFAEAPPGDPKAGEKIFKTKCAQCHTVDQGAGHKQGPNLNGLFGRQSGTASGYSYSAANKNKAVVWEESTLYDYLLNPKKYIPGTKMVFPGLKKPQERADLIAYLKQSTA

SEQ ID NO: 5175 - protein, 112 aa, Cirsium arvense
MASFAEAPAGNPTVGEKIFKTKCAQCHTVEKGSGHKQGPNLNGLFGRQSGTTAGYSYSAANKNKAVQWEENTLYDYLLNPKKYIPGTKMVFPGLKKPQERADLIAYLKASTA

SEQ ID NO: 5176 - protein, 112 aa, Flaveria ramosissima
MASFAEAPAGNPAAGEKIFKTKCAQCHTVEKGAGHKQGPNLNGLFGRQSGTTAGYSYSAGNKNKAVIWEESTLYDYLLNPKKYIPGTKMVFPGLKKPQERADLIAYLKASTA

SEQ ID NO: 5177 - protein, 112 aa, Flaveria ramosissima
MASFAEAPAGNPAAGEKIFKTKCAQCHTVEKGAGHKQGPNLNGLFGRQSGTTAGYSYSAGNKNKAVIWEENTLYDYLLNPKKYIPGTKMVFPGLEKPQERADLIAYLKASTA

SEQ ID NO: 5178 - protein, 112 aa, Flaveria ramosissima
MTSFEQAPPGDAKAGEKIFKTKCAQCHTVDKGAGHKQGPNLNGLFGRQSGTTAGYSYSAANKNMAVIWEENTLYDYLLNPKKYIPGTKMVFPGLKKPQDRADLIAYLKQSTA

SEQ ID NO: 5179 - protein, 112 aa, Papaver somniferum
MATFQEAPPGDVKAGEKIFKTKCAQCHTVEKGSGHKQGPNLNGLFGRQSGTTAGYSYSAANKNKAVNWEENTLYDYLLNPKKYIPGTKMVFPGLKKPQERADLIAYLKQSTA

SEQ ID NO: 5180 - protein, 112 aa, Utricularia gibba
MASFGEAPPGDLKSGEKIFKTKCAQCHTVDKGAGHKQGPNLNGLFGRQSGTTPGYSYSAANKNMAVIWEEKALYDYLLNPKKYIPGTKMVFPGLKKPQERADLIAYLKNATA

SEQ ID NO: 5181 - protein, 112 aa, Abies balsamea
MATFSEAPPGDAKAGEKIFKTKCAQCHTVDKGAGHKQGPNLNGLFGRQSGTTAGYSYSSANKNKAVNWGEDTLYEYLLNPKKYIPGTKMVFPGLKKPQERVDLIAYLKQATS

SEQ ID NO: 5182 - protein, 112 aa, Malus domestica
MASFAEAPPGDAKTGEKIFKTKCAQCHTVEKGAGHKQGPNLNGLFGRQSGTGAGYSYSAANKNKAVTWEENTLYDYLLNPKKYIPGTKMVFPGLKKPQERADLIAYLKQSTA

SEQ ID NO: 5183 - protein, 112 aa, Manihot esculenta
MATFEQAPPGDQKAGEKIFKTKCAQCHTVEKGAGHKQGPNLNGLFGRQSGTTAGYSYSAANKNMAVIWEENTLYDYLLNPKKYIPGTKMVFPGLKKPQDRTDLIAYLKEATA

SEQ ID NO: 5184 - protein, 112 aa, Cephalotaxus harringtonia
MASFTEAPPGDEKAGEKIFKTKCAQCHTVEKGAGHKQGPNLNGLFGRQSGTTAGYSYSAANKNKAVTWGEDTLYDYLLNPKKYIPGTKMVFPGLKKPQDRADLIAYLKKATS

SEQ ID NO: 5185 - protein, 112 aa, Cichorium intybus
MASFAEAPAGNATAGEKIFKTKCAQCHTVEKGAGHKQGPNLNGLFGRQSGTTAGYSYSAANKSKAVTWEENTLYDYLLNPKKYIPGTKMVFPGLKKPQERADLIAYLKSSTA

SEQ ID NO: 5186 - protein, 112 aa, Citrus sinensis
MASFEEAPPGNPKAGEKIFKTKCAQCHTVVKGAGHKQGPNLNGLFGRQSGTTPGYSYSAANKGMAVIWEEKTLYNYLLNPKKYIPGTKMVFPGLKKPQDRADLIAYLKESTA

SEQ ID NO: 5187 - protein, 112 aa, Taraxacum officinale
MASFAEAPAGNATVGEKIFKTKCAQCHTVEKGAGHKQGPNLNGLFGRQSGTTAGYSYSAANKNKAVNWEENTLYDYLLNPKKYIPGTKMVFPGLKKPQDRADLIAYLKASTA

SEQ ID NO: 5188 - protein, 112 aa, Zingiber officinale
MASFTEAPPGDAKAGEKIFKTKCSQCHTVEKGAGHKQGPNLNGLFGRQSGTTAGYSYSAANKNMAVIWEESTLYDYLLNPKKYIPGTKMVFPGLKKPQERADLIAYLKSSTA

SEQ ID NO: 5189 - protein, 112 aa, Zingiber officinale
MASFAEAPPGDAKAGEKIFKTKCAQCHTVEKGAGHKQGPNLNGLFGRQSGTGAGYSYSAANKNMAVIWEESTLYDYLLNPKKYIPGTKMVFPGLKKPQERADLIAFLKSSTA

SEQ ID NO: 5190 - protein, 112 aa, Guizotia abyssinica
MASFAEAPAGNVTAGEKIFKMKCAQCHTVEKGAGHKQGPNLNGLFGRQSGTTAGYSYSAANKNKAVSWEENTLYDYLLNPKKYIPGTKMVFPGLKKPQERADLIAYLKASTA

SEQ ID NO: 5191 - protein, 112 aa, Hevea brasiliensis
MATFEQAPPGDPKAGEKIFKTKCAQCHTVEKGAGHKQGPNLNGLFGRQSGTTAGYSYSAANKNMAVIWEEKALYDYLLNPKKYIPGTKMVFPGLKKPQERADLIAYLKDATA

SEQ ID NO: 5192 - protein, 112 aa, Tropaeolum majus
MATFAEAPAGNSKAGEKIFKTKCAQCHTAEKGAGHKQGPNLNGLFGRQSGTTPGYSYSAANKNMAVTWEENTLYDYLLNPKKYIPGTKMVFPGLKKPQDRADLIAYLKDATA

SEQ ID NO: 5193 - protein, 112 aa, Olea europaea
MASFNEPPPGNVKPGENIFKTKCAQCHTVEKGAGHKQGPNLSGLFGRQSGTTPGYSYSAANKNMAVTWEENTLYDYLLNPKKYIPGTKMVFPGLKKPQERADLIAYLKEATA

SEQ ID NO: 5194 - protein, 112 aa, Orobanche aegyptiaca
MASYTEAPAGSAQAGEKIFRTKCAQCHTVDKGAGHKQGPNLNGLFGRQSGTTAGYSYSAANKNKAVDWGEDTLYDYLLNPKKYIPGTKMVFPGLKKPQERADLIAYLKEATA

SEQ ID NO: 5195 - protein, 112 aa, Lippia dulcis
MASFEEAPPGNKAVGEKIFKTKCAQCHTVDKGAGHKQGPNLNGLFGRQSGTTAGYSYSAASKNMAVIWEEKTLYDYLLNPKKYIPGTKMVFPGLKKPQDRADLIAYLKESTA

SEQ ID NO: 5196 - protein, 112 aa, Silene vulgaris
MASFGEAPAGNPKAGEKIFRTKCAQCHTVDQGAGHKQGPNLNGLFGRQSGTAGGYSYSAANKNKAVNWAEDTLYDYLLNPKKYIPGTKMVFPGLKKPQERADLIAYLKESTA

SEQ ID NO: 5197 - protein, 112 aa, Helianthus annuus
MASFAEAPAGNPTTGEKIFKTKCAQCHTVEKGAGHKQGPNLNGLFGRQSGTTAGYSYSAGNKNKAVIWEENTLYDYLLNPKKYIPGTKMVFPGLKKPQERADLIAYLKTSTA

SEQ ID NO: 5198 - protein, 112 aa, Tragopogon dubius
MASFEQAPGGDAKVGEKIFKTKCAQCHTVEKGAGHKQGPNLNGLFGRQSGTTAGYSYSAANKNMAVNWGENTLYDYLLNPKKYIPGTKMVFPGLKKPQDRADLIAYLKQSTA

SEQ ID NO: 5199 - protein, 93 aa, Sarracenia psittacina
MASFDQAPAGDAKTGEKIFRTKCAQCHTVDKGAGHKQGPNLNGLFGRQSGTTAGYSYSAANKNMAVTWGENTLYDYLLNPKKYIPGTKMVFRD

SEQ ID NO: 5200 - protein, 67 aa, Setaria italica
MVCLGTTPGYSYSSANKNMAVIWEENTLYDYLLNPKKYIPGTKMVFPGLKKPQERADLIAYLKNATA

SEQ ID NO: 5201 - protein, 93 aa, Triphysaria pusilla
MASFAEAPPGNKAAGEKIFKTKCAQCHTVEKGAGHKQGPNLNGLFGRQSGTTPGYSYSAANKNMAVTWEEKTLYEYLSTPRSIYRGRRWFFRD

SEQ ID NO: 5202 - protein, 352 aa, Medicago truncatula
MELFEPTLPRNRAAGEKIFRSDCAQCHSNIGAVHKQGPNLNGLFGSQSGTTPEYSYCVANKNMSMNWEEKIMDDYLLNPNKYILDTKMVFPALKKPQERVDLIDAIEVKWSSWGARSERDWFKRTQRLSTRSRNKLFGSYTFHDFVTARARCAITTALQHSTSINRGLTAVPKVESISSSKPSLFYLYLLERRSACRYTPPSAPRSILAPHSVAHILISFTFLYNSFATRCSFAELSQMASFDEAPPGNPAAGEKIFRTKCAQCHTVDKGAGHKQGPNLNGLFGRQSGTTPGYSYSAANKNKAVDWEEKTLYDYLLNPKKYIPGTKMVFPGLKKPQERADLIAYLKDATSKE

SEQ ID NO: 5203 - protein, 114 aa, Cicer arietinum
MASFDEAPPGNPEAGEKIFRTKCAQCHTVDKGAGHKQGPNLNGLFGRQSGTTPGYSYSAANKNMAVNWEEKTLYDYLLNPKKYIPGTKMVFPGLKKPKERADLIAYLKNATSKE

SEQ ID NO: 5204 - protein, 114 aa, Picea glauca
MASFSEAPPGDAKAGEKIFKTKCAQCHTVDKGAGHKQGPNLNGLFGRQSGTTAGYSYSAANKNKAVNWGEDTLYEYLLNPKKYIPGTKMVFPGLKKPQERVDLIAYLKKATSSD

SEQ ID NO: 5205 - protein, 114 aa, Pinus taeda
MATFSEAPPGDAKAGEKIFKTKCAQCHTVDKGAGHKQGPNLNGLFGRQSGTTAGYSYSAANKNKAVDWGEDTLYDYLLNPKKYIPGTKMVFPGLKKPQERADLIAYLKQATSSG

SEQ ID NO: 5206 - protein, 113 aa, Unknown
  Sequence found in Organisms: Gossypium hirsutum, Gossypium raimondii
MASFEQAPPGNAKAGEKIFKTKCSQCHTVDKGAGHKQGPNLNGLFGRQSGTTPGYSYSAANKNMAVIWEEKTLYDYLLNPKKYIPGTKMVFPGLKKPQDRADLIAYLKESTAS

SEQ ID NO: 5207 - protein, 113 aa, Elaeis guineensis
MASFAEAPPGDKKSGEKIFKTKCAQCHTVEKGAGHKQGPNLNGLFGRQSGTTPGYSYSAANKNMAVIWEESTLYVYLLNPKKYIPGTKMVFPGLKKPQERADLIAYLKESTAS

SEQ ID NO: 5208 - protein, 113 aa, Aristolochia fimbriata
MATFAEAPPGDEKSGEKIFKTKCAQCHTVDKGAGHKQGPNLNGLFGRQSGTTPGYSYSAANKNMAVIWGECTLYDYLLNPKKYIPGTKMVFPGLKKPQERADLIAYLRASTAS

SEQ ID NO: 5209 - protein, 113 aa, Castanea mollissima
MASFSEAPPGDPKVGEKIFKTKCAQCHTVDKGAGHKQGPNLNGLFGRQSGTTPGYSYSAANKNMAVNWEEKTLYDYLLNPKKYIPGTKMVFPGLKKPQDRADLISYLKQSTAS

SEQ ID NO: 5210 - protein, 113 aa, Festuca arundinacea
MASFSEAPPGNPAAGAKIFKTKCAQCHTVEKGAGHKQGPNLHGLFGRQSGTTAGYSYSAANKNKAVDWEENTLYDYLLNPKKYIPGTKMVFPGLKKPQDRADLIAYLKEATSS

SEQ ID NO: 5211 - protein, 113 aa, Glycyrrhiza uralensis
MASFDEAPPGNPAAGEKIFKMKCAQCHTVDKGAGHKQGPNLNGLFGRQSGTTPGYSYSAANKNMAVIWEEKTLYDYLLNPKKYIPGTKMVFPGLKKPQDRADLIAYLKDATSK

SEQ ID NO: 5212 - protein, 113 aa, Medicago truncatula
MASFELAPPGDAKSGDKIFRTKCAQCHTVDKGAGHKQGPNLNGLFGRQSGTTPGYSYSAANKNMAVNWEEKTLYDYLLNPKKYIPGTKMVFPGLKKPQERADLIAYLKEATAQ

SEQ ID NO: 5213 - protein, 113 aa, Quercus alba
MASFSEAPPGDPKVGEKIFKTKCAQCHTVDKGAGHKQGPNLNGLFGRQSGTTPGYSYSTANKNMAVNWEEKTLYDYLLNPKKYIPGTKMVFPGLKKPQDRADLISYLKQSTAS

SEQ ID NO: 5214 - protein, 113 aa, Arachis hypogaea
MASFSEAPPGDSKAGEKIFKTKCAQCHTVDKGAGHKQGPNLNGLFGRQSGTTPGYSYSAANKNMAVIWEENTLYDYLLNPKKYIPGTKMVFPGLKKPKDRADLIAYLKESTSQ

SEQ ID NO: 5215 - protein, 113 aa, Trigonella foenum-graecum
MASFEQAPPGDAKSGDKIFRTKCAQCHTVDKGAGHKQGPNLNGLFGRQSGTTPGYSYSAANKNMAVNWEEKTLYDYLLNPKKYIPGTKMVFPGLKKPQERADLIAYLKEATAQ

SEQ ID NO: 5216 - protein, 112 aa, Cirsium arvense
MASFEQAPGGDAKVGEKIFKTKCAQCHTVEKGAGHKQGPNLNGLFGRQSGTTAGYSYSAANKNMAVIWGENTLYDYLLNPKKYIPGTKMVFPGLKKPQDRADLIAYLKQSTA

SEQ ID NO: 5217 - protein, 112 aa, Papaver somniferum
MATFQEAPPGDVKAGEKIFKTKCAQCHTVEKGSGHKQGPNLNGLFGRQSGTTAGYSYSAANKNKAVNWEENTLYDYLLNPKKYIPGTKMVFPGLKKPQDRADLIAYLKQSTA

SEQ ID NO: 5218 - protein, 112 aa, Eutrema parvulum
MASFNEAPPGNSKTGEKIFRTKCAQCHTVDQGAGHKQGPNLNGLFGRQSGTTPGYSYSAANKNMAVMWEEKTLYDYLLNPKKYIPGTKMVFPGLKKPQDRADLIAYLKEGTA

SEQ ID NO: 5219 - protein, 112 aa, Arnica chamissonis
MASFAEAPAGNATTGEKIFKTKCAQCHTVEKGAGHKQGPNLNGLFGRQSGTTAGYSYSAGNKNKAVIWEENTLYDYLLNPKKYIPGTKMVFPGLKKPQERADLIAYLKASTA

SEQ ID NO: 5220 - protein, 112 aa, Brachypodium distachyon
MASFSEAPPGNQATGEKIFKTKCAQCHTVEKGAGHKQGPNLNGLFGRQSGTTPGYSYSSANKSMAVIWEEKTLYDYLLNPKKYIPGTKMVFPGLKKPQERADLIAYLKSATA

SEQ ID NO: 5221 - protein, 112 aa, Cynara scolymus
MASFAEAPAGNPTVGEKIFKTKCAQCHTVEKGSGHKQGPNLNGLFGRQSGTTAGYSYSAANKNKAVTWEENTLYDYLLNPKKYIPGTKMVFPGLKKPQDRADLIAYLKASTA

SEQ ID NO: 5222 - protein, 112 aa, Unknown
  Sequence found in Organisms: Euphorbia peplus, Euphorbia esula
MASFEQAPPGDAKAGEKIFKTKCAQCHTVDQGAGHKQGPNLHGLFGRQSGTTAGYSYSAANKNKAVEWGEDTLYDYLLNPKKYIPGTKMVFPGLKKPQDRADLIAYLKQATA

SEQ ID NO: 5223 - protein, 112 aa, Fagopyrum esculentum
MATFSEAPPGNIKSGEKIFKTKCAQCHTVEKGAGHKQGPNLNGLFGRQSGTTAGYSYSAANKNKAVTWGEDTLYDYLLNPKKYIPGTKMVFPGLKKPQERADLIAYLKDSTQ

SEQ ID NO: 5224 - protein, 112 aa, Gerbera hybrid cultivar
MASFAEAPAGNATAGEKIFKTKCAQCHTVEKGAGHRQGPNLNGLFGRQSGTTPGYSYSAANKNKAVTWEENTLYDYLLNPKKYIPGTKMVFPGLKKPQERADLIAYLKSSTA

SEQ ID NO: 5225 - protein, 112 aa, Tropaeolum majus
MASFEEAPAGNSKAGDKIFRTKCAQCHTVDKGAGHKQGPNLNGLFGRQSGTTAGYSYSAANKNKAVVWDESTLYDYLLNPKKYIPGTKMVFPGLKKPQDRADLIAYLKESTA

SEQ ID NO: 5226 - protein, 112 aa, Pisum sativum
MASFEQAPPGDSKAGDKIFRTKCAQCHTVEKGAGHKQGPNLNGLFGRQSGTTPGYSYSAANKAMAVNWEEKTLYDYLLNPKKYIPGTKMVFPGLKKPQERADLIAYLKEATA

SEQ ID NO: 5227 - protein, 112 aa, Lippia dulcis
MASFEEAPPGNKAAGEKIFKTKCAQCHTVDKGAGHKQGPNLNGLFGRQSGTTPGYSYSAGNKNKAVIWEEKTLYDYLLNPKKYIPGTKMVFPGLKKPQDRADLIAYLKESTA

SEQ ID NO: 5228 - protein, 111 aa, Silene vulgaris
ASFGEAPAGNPKAGEKIFKMKCAQCHTVDQGAGHKQGPNLNGLFGRQSGTAAGYSYSAANKNKAVHWGEDTLYDYLLNPKKYIPGTKMVFPGLKKPQDRADLIAYLKESTA

SEQ ID NO: 5229 - protein, 112 aa, Fragaria vesca
MASFAEAPPGDAKVGEKIFRTKCAQCHTVDKGAGHKQGPNLNGLFGRQSGTTPGYSYSAANKNMAVQWEEKTLYDYLLNPKKYIPGTKMVFPGLKKPQDRADLIAYLKQSTA

SEQ ID NO: 5230 - protein, 112 aa, Taxus baccata
MASFAEAPPGNEKAGEKIFKTKCAQCHTVEKGAGHKQGPNLNGLFGRQSGTTAGYSYSTANKTKAVTWGEDALYEYLLNPKKYIPGTKMVFPGLKKPQDRADLIAYLKKATS

SEQ ID NO: 5231 - protein, 100 aa, Flaveria ramosissima
MASFEQAPPGDAKAGEKIFKTKCAQCHTVEKGAGHKQGPNLNGLFGRQSGTTAGYSYSAANKNMAVIWGENTLYDYLLNPKKYIPGTRWYSWTEETTRSG

SEQ ID NO: 5232 - protein, 93 aa, Secale cereale
MASFSEAPPGNPASGEKIFKTKCAQCHTVDKGAGHKQGPNLNGLFGRQSGTTPGYSYSTANKLMAVNWEEKTLYDYLLNPKKYIPGTKMVFPD

SEQ ID NO: 5233 - protein, 129 aa, Vinca minor
EIPKSALFWLEFESDKWLPSNKHRPVIAKSGEKIFRTKCAQCHTVRQRCRSQTRPQFRMAFFGRQSGTTPGYSYSAANKNMAVNWGENTLYDYLLNPKKYIPGTKMVFPGLKKPQDRADLIAYLKESTA

SEQ ID NO: 5234 - protein, 62 aa, Setaria italica
RWRLSQRRPRGTPRPARRSSRPSARSATPSTRAPATSKVSTRVEWSVWEAVWYNSWLLLLLG

SEQ ID NO: 5235 - protein, 114 aa, Valeriana officinalis
MASFTEAPPGNADAGAKIFKTKCAQCHTVEQGAGHKQGPNLNGLFGRQSGTTAGYSYSAANKNMAVNWEEKTLYDYLLNPKKYIPGTKMVFPGLKKPQDRADLIAYLKTATAPK

SEQ ID NO: 5236 - protein, 114 aa, Cucumis sativus
MASFDEAPPGNSKTGEKIFKTKCAQCHTVDKGAGHKQGPNLNGLFGRQSGTTPGYSYSAANKNMAVIWEEKTLYDYLLNPKKYIPGTKMVFPGLKKPQDRADLIAYLKESTNSA

SEQ ID NO: 5237 - protein, 114 aa, Medicago truncatula
MASFDEAPPGNPAAGEKIFRTKCAQCHTVDKGAGHKQGPNLNGLFGRQSGTTPGYSYSAANKNKAVDWEEKTLYDYLLNPKKYIPGTKMVFPGLKKPQERADLIAYLKDATSKE

SEQ ID NO: 5238 - protein, 113 aa, Fagus grandifolia
MASFEQAPPGDPKVGEKIFKTKCAQCHTVDKGAGHKQGPNLNGLFGRQSGTTPGYSYSAANKNMAVNWEEKTLYDYLLNPKKYIPGTKMVFPGLKKPQDRADLISYLKQSTAS

SEQ ID NO: 5239 - protein, 113 aa, Gossypium hirsutum
MASFAQAPPGDSKSGEKIFKTKCAQCHTVEKAAGHKQGPNLNGLFGRQSGTAPGYSYSAANKSMAVIWGENTLYDYLLNPKKYIPGTKMVFPGLKKPQERADLIAYLKESTAS

SEQ ID NO: 5240 - protein, 113 aa, Avena sativa
MASFSEAPPGNPAAGAKIFKTKCAQCHTVEQGAGHKQGPNLHGLFGRQSGTTAGYSYSAANKNKAVDWEENTLYDYLLNPKKYIPGTKMVFPGLKKPQDRADLIAYLKEATSS

SEQ ID NO: 5241 - protein, 113 aa, Avena sativa
MASFSEAPPGNPAAGAKIFKTKCAQCHTVEKGAGHKQGPNLHGLFGRQSGTTHGYSYSAANKNKAVDWEENTLYDYLLNPKKYIPGTKMVFPGLKKPQDRADLIAYLKEATSS

SEQ ID NO: 5242 - protein, 113 aa, Phalaenopsis aphrodite
MASFSEAPPGDSKAGEKIFKTKCAQCHTVEKGAGHKQGPNLNGLFGRQSGTTPGYSYSTANKNMAVIWEESTLYDYLLNPKKYIPGTKMVFPGLKKPQERADLIAFLKESTSS

SEQ ID NO: 5243 - protein, 113 aa, Unknown
  Sequence found in Organisms: Hordeum vulgare, Secale cereale, Triticum aestivum
MASFSEAPPGNPDAGAKIFKTKCAQCHTVDAGAGHKQGPNLHGLFGRQSGTTAGYSYSAANKNKAVEWEENTLYDYLLNPKKYIPGTKMVFPGLKKPQDRADLIAYLKKATSS

SEQ ID NO: 5244 - protein, 113 aa, Acacia harpophylla
MASFDEAPPGNPQSGAKIFKTKCAQCHTVEKSAGHKQGPNLNGLFGRQSGTTPGYSYSAANKNMAVIWEEKTLYDYLLNPKKYIPGTKMVFPGLKKPQERADLIAYLKEATSQ

SEQ ID NO: 5245 - protein, 113 aa, Amsonia hubrichtii
MASFEQAPPGDAKVGEKIFKTKCAQCHTVVKGSGHKQGPNLNGLFGRQSGTTPGYSYSAANKNMAVTWGENTLYDYLLNPKKYIPGTKMVFPGLKKPQDRADLIAYLKESTAA

SEQ ID NO: 5246 - protein, 112 aa, Cicer arietinum
MASFEQAPAGDAKAGDKIFRTKCAQCHTVDKGAGHKQGPNLNGLFGRQSGTTPGYSYSAANKSMAVTWEEKTLYDYLLNPKKYIPGTKMVFPGLKKPQERADLIAYLKEATA

SEQ ID NO: 5247 - protein, 112 aa, Flaveria ramosissima
MASFDQAPPGDAKAGEKIFKTKCAQCHTVEKGAGHKQGPNLNGLFGRQSGTTAGYSYSAANKNMAVIWEENTLYDYLLNPKKYIPGTKMVFSGLKKPQDRANLIAYLKQSTA

SEQ ID NO: 5248 - protein, 112 aa, Allium cepa
MASFSEAPPGNEKSGEKIFKTKCAQCHSVEKGAGHKQGPNLNGLFGRQSGTAAGYSYSAANKNKAVVWEENTLYEYLLNPKKYIPGTKMVFPGLKKPQDRADLIAYLKKATA

SEQ ID NO: 5249 - protein, 112 aa, Allium cepa
MASFAEAPPGNKTAGEKIFKTKCAQCHTVEQGAGHKQGPNLNGLFGRQSGTAAGYSYSAANKTKAVVWEESTLYDYLLNPKKYIPGTKMVFPGLKKPQDRADLIAYLKESTA

SEQ ID NO: 5250 - protein, 112 aa, Eutrema halophilum
MASFDEAPPGNPTAGDKIFRLKCAQCHTVEKGAGHKQGPNLNGLFGRQSGTTAGYSYSAANKNKAVEWEEKTLYDYLLNPKKYIPGTKMVFPGLKKPQDRADLIAYLKNATA

SEQ ID NO: 5251 - protein, 112 aa, Arnica chamissonis
MASFEQAPAGDAKSGEKIFRTKCAQCHTVDKGAGHKQGPNLNGLFGRQSGTTAGYSYSAANKNMAVIWGENTLYDYLLNPKKYIPGTKMVFPGLKKPQDRADLIAYLKQSTS

SEQ ID NO: 5252 - protein, 112 aa, Ocimum basilicum
MASFEEAPPGNKDAGAKIFKTKCAQCHTVEKGAGHKQGPNLNGLFGRQSGTTPGYSYSAANKSMAVIWEEKTLYDYLLNPKKYIPGTKMVFPGLKKPQDRADLIAYLKESTA

SEQ ID NO: 5253 - protein, 112 aa, Bruguiera gymnorhiza
MASFQEAPPGDVKAGEKIFRTKCAQCHTAEKGAGHKQGPNLNGLFGRQSGTTAGYSYSAANKNRAVIWEENTLYDYLLNPKKYIPGTKMVFPGLKKPKERTDLIAYLKESTA

SEQ ID NO: 5254 - protein, 112 aa, Cryptomeria japonica
MASFAEAPPGNEKAGEKIFKTKCAQCHTVDKGAGHKQGPNLNGLFGRQSGTTAGYSYSAANKSKAVIWGEDALYEYLLNPKKYIPGTKMVFPGLKKPQDRVDLIAYLKKSTD

SEQ ID NO: 5255 - protein, 112 aa, Taraxacum officinale
MASFEQAPGGDAKVGEKIFKTKCAQCHTVEKGAGHKQGPNLNGLFGRQSGTTAGYSYSAANKNRAVVWEENTLYDYLLNPKKYIPGTKMVFPGLKKPQERADLIAYLKQSTA

SEQ ID NO: 5256 - protein, 112 aa, Fagopyrum esculentum
MASFSEAPPGDLKSGEKIFKMKCAQCHTVEKGAGHKQGPNLNGLFGRQSGTTAGYSYSAANKNKAVTWGEDTLYDYLLNPKKYIPGTKMVFPGLKKPQERADLIAYLKDSTQ

SEQ ID NO: 5257 - protein, 112 aa, Lactuca sativa
MASFEQAPGGDAKVGEKIFKTKCAQCHTVEKGAGHKQGPNLNGLFGRQSGTTAGYSYSAANKNMAVTWGENTLYDYLLNPKKYIPGTKMVFPGLKKPQDRADLIAYLKQSTS

SEQ ID NO: 5258 - protein, 112 aa, Sciadopitys verticillata
MATFSEAPPGDEKSGEKIFKTKCAQCHTVDKGAGHKQGPNLNGLFGRQSGTTAGYSYSAANKNKAVNWEEETLYEYLLNPKKYIPGTKMVFPGLKKPKERADLIAYLKQATS

SEQ ID NO: 5259 - protein, 112 aa, Camellia sinensis
MASFDQAPPGDSKSGEKIFRTKCAQCHTVEKGAGHKQGPNLNGLFGRQSGTTPGYSYSNANKSMAVNWEEKTLYDYLLNPKKYIPGTKMVFPGLKKPQERADLIAYLKQATS

SEQ ID NO: 5260 - protein, 77 aa, Allium cepa
MASFAEAPPGNKTAGEKIFKTKCAQCHTVEQGAGHKQGPNLNGLFGRQSGTAAGYSYSAANKPKLWFGKRVLCMITC

SEQ ID NO: 5261 - protein, 100 aa, Sequoia sempervirens
MASFSEAPPGDPKVGEKIFKTKCAQCHTVDKGAGHKQGPNLNGLFGRQSGTTPGYSYSTANKNMAVNWEEKTLYDYLLNPKSTFLGLRWYSPAEEATGSG

SEQ ID NO: 5262 - protein, 93 aa, Triticum aestivum
MASFSEAPPGNPKAGEKIFKTKCAQCHTVEKGAGHKQGPNLNGLFGRQSGTTTGYSYSAGNKNKAVVWEENTLYDYLLNPKNTFLEPRWCSLG

SEQ ID NO: 5263 - protein, 114 aa, Cycas rumphii
MASFSEAPPGDPEAGEKIFKTKCAQCHTVEKGAGHKQGPNLNGLFGRQSGTTAGYSYSAGNKNKAVIWGEETLYEYLLNPKKYIPGTKMVFPGLKKPQERADLIAYLKQATSPD

SEQ ID NO: 5264 - protein, 114 aa, Pinus pinaster
MATFSEAPPGDSKAGEKIFKTKCAQCHTVDKGAGHKQGPNLHGLFGRQSGTTAGYSYSAANKNKAVDWGEDTLYEYLLNPKKYIPGTKMVFPGLKKPQERADLIAYLKKATSSD

SEQ ID NO: 5265 - protein, 65 aa, Eutrema parvulum
MRSARSCGFFSPGNTIFVPGIYLLWVQQVIVKSLLLPHHGHVFVGSRVRIPWSGSRLPSEQTIQV

SEQ ID NO: 5266 - protein, 113 aa, Amborella trichopoda
MATFNEAPPGNDKAGEKIFKTKCAQCHTVDKGAGHKQGPNLNGLFGRQSGTTPGYSYSAGNKNKAVIWEESTLYDYLLNPKKYIPGTKMVFPGLKKPQERTDLIAYLKGATSS

SEQ ID NO: 5267 - protein, 113 aa, Unknown
  Sequence found in Organisms: Gossypium hirsutum, Gossypium raimondii
MASFAQAPRGDSKSGEKIFKTKCAQCHTVEKAAGHKQGPNLNGLFGRQSGTAPGYSYSAANKSMAVIWGENTLYDYLLNPKKYIPGTKMVFPGLKKPQERADLIAYLKESTAS

SEQ ID NO: 5268 - protein, 113 aa, Avena sativa
MASFSEAPPGNPAAGAKIFKTKCAQCHTVEQGAGHKQGPNLHGLFGRQSGTTADYSYSAANKNKAVDWEENTLYDYLLNPKKYIPGTKMVFPGLKKPQDRADLIAYLKEATSS

SEQ ID NO: 5269 - protein, 111 aa, Trifolium pratense
SFDEAPPGNPTAGDKIFRTKCAQCHTVDKGAGHKQGPNLNGLFGRQSGTTPGYSYSAANKNKAVEWEEKTLYDYLLNPKKYIPGTKMVFPGLKKPQERADLIAYLKEATSK

SEQ ID NO: 5270 - protein, 113 aa, Lolium multiflorum
MASFSEAPPGNPAAGAKIFKTKCAQCHTVEQGAGHKQGPNLHGLFGRQSGTTAGYSYSAANKNKAVEWEENTLYDYLLNPKKYIPGTKMVFPGLKKPQDRADLIAYLKDATSS

SEQ ID NO: 5271 - protein, 113 aa, Lotus japonicus
MASFDEAPPGDTKAGEKIFKIKCAQCHTVDQGAGHKQGPNLNGLFGRQSGTTPGYSYSAANKNMAVIWEEKTLYDYLLNPKKYIPGTKMVFPGLKKPQDRADLIAYLKQSTAQ

SEQ ID NO: 5272 - protein, 113 aa, Avena sativa
MASFSEAPPGNPAAGAKIFKTKCAQCHTVEQGAGHKQGPNLHGLFGRQSGTTHGYSYSAANKNKAVDWEENTLYDYLLNPKKYIPGTKMVFPGLKKPQDRADLIAYLKEATSS

SEQ ID NO: 5273 - protein, 113 aa, Arachis hypogaea
MASFDQAPPGDSKSGEKIFKTKCAQCHTVEKGAGHKQGPNLNGLFGRQSGTTTGYSYSAANKSMAVTWEEKTLYDYLLNPKKYIPGTKMVFPGLKKPQERADLIAYLKESTAQ

SEQ ID NO: 5274 - protein, 113 aa, Cajanus cajan
MASFDQAPPGDVKSGDKIFRTKCAQCHTVEKGAGHKQGPNLNGLFGRQSGTTPGYSYSAANKNMAVTWEEKTLYDYLLNPKKYIPGTKMVFPGLKKPQERADLIAYLKEATAQ

SEQ ID NO: 5275 - protein, 113 aa, Platanus occidentalis
MATFSEAPPGDAKTGEKIFKTKCAQCHTVDKGAGHKQGPNLNGLFGRQSGTTPGYSYSAANKNMAVIWEEKTLYDYLLNPKKYIPGTKMVFPGLKKPQERADLIAYLKASTSS

SEQ ID NO: 5276 - protein, 113 aa, Populus trichocarpa
MASFAEAPPGDSKVGEKIFKTKCAQCHTVDKGAGHKQGPNLNGLFGRQSGTTAGYSYSAAHKNMAVTWEEKTLYDYLLNPKKYIPGTKKDFPGLKKPQERADVIAYLKQSTAS

SEQ ID NO: 5277 - protein, 110 aa, Thalictrum flavum
FDEAPPGNPKAGEKIFKTKCAQCHTVEKGAGHKQGPNLNGLFGRQSGTTPGYSYSAGNKNKAVIWEEKTLYDYLLNPKKYIPGTKMVFPGLKKPQERADLIAYLKESTAA

SEQ ID NO: 5278 - protein, 112 aa, Tripterygium wilfordii
ASFDQAPPGDSKSGEKIFKTKCAQCHTVDKGAGHKQGPNLNGLFGRQSGTTPGYSYSAANKNMAVNWEEKTLYDYLLNPKKYIPGTKMVFPGLKKPQDRADLIAYLKESTSP

SEQ ID NO: 5279 - protein, 113 aa, Juglans hindsii x Juglans regia
  misc_feature (24)..(24): Xaa can be any naturally occurring amino acid
MASFDQAPPGDPKVGEKIFRTKCXQCHTVDKGAGHKQGPNLNGLFGRQSGTTAGYSYSTANKNMAVTWEEKTLYDYLLNPKKYIPGTKMVFPGLKKPQDRADLISYLKESTAS

SEQ ID NO: 5280 - protein, 113 aa, Juglans hindsii x Juglans regia
MASFDQAPPGDPKVGEKIFRTKCAQCHTVEKGAGHKQGPNLNGLFGRQSGTTAGYSYSTANKNMAVIWEEKTLYDYLLNPKKYIPGTKMVFPGLKKPQERADLISYLKASTAS

SEQ ID NO: 5281 - protein, 93 aa, Allium cepa
MASFSEAPPGNEKSGEKIFKTKCAQCHSVEKGAGHKQGPNLNGLFGRQSGTAAGYSYSAANKNKAVVWEEIHCTSTCLIQKSISLEQRWCSLV

SEQ ID NO: 5282 - protein, 109 aa, Secale cereale
MASFVGRPPGNPASGEKIFKTKCAQCHTVDKGAGHKQGPNLNGLFGRQSGTTPGYSYSTANKLMAVNWEEKTLYDYLLNPKKYIPGTKMVFPGLKKPQERADLIAYLKG

SEQ ID NO: 5283 - protein, 125 aa, Artemisia annua
MESDVSVTVRLQIVYGKLSIRSVRNAFEDSVGTRLKKFGGSDNKELLHKFTSQFSDEYKIPRGSIINLSKEKGYVLRTTIDGKEVGSVQSQLLCRSILDLYIGDEPFDSKAKEDIDNKLVSAITE

SEQ ID NO: 5284 - protein, 61 aa, Castanea mollissima
KNPNNPFVSESDQNLSTKKKNRRASQKHHREIPRSARKSSRPSALNATPSTKALVTNKDLI

SEQ ID NO: 5285 - protein, 77 aa, Fagopyrum esculentum
MATFSEAPPGNIKSGEKIFKTKCAQCHTVEKGAGHKQGPNLNGLFGRQSGTTAGYSYSAANKTRLLHGEKTPCTSTC

SEQ ID NO: 5286 - protein, 112 aa, Zingiber officinale
MASFTEAPPGDAKSGEKIFKTKCSQCHTVEKGAGHKQGPNLNGLFGRQSGTTPGYSYSTANKNMAVIWEESTLYDYLLNPKKYIPGTKMVFPGLKKPQERSDLIAYLKSSTA

SEQ ID NO: 5287 - protein, 112 aa, Actinidia deliciosa
MATFNEAPPGDVKSGDKIFRTKCAQCHTVEKGAGHKQGPNLNGLFGRQSGTTPGYSYSAANKNMAVAWGENTLYDYLLNPKKYIPGTKMVFPGLKKPQDRADLIAYLKQATS

SEQ ID NO: 5288 - protein, 112 aa, Helianthus annuus
MASFEQAPAGDAKAGEKIFRTKCAQCHTVDKGAGHKQGPNLNGLFGRQSGTTAGYSYSAANKNMAVIWEEKTLYDYLLNPKKYIPGTKMVFPGLKKPKDRADLIAYLKQSTA

SEQ ID NO: 5289 - protein, 57 aa, Thellungiella halophila
  misc_feature (40)..(40): Xaa can be any naturally occurring amino acid
EIRVHFLLLFPVPLPAKMASFDEAPPGNPRPVIRSSGSSXLSATPSKKAPVTNKDRI

SEQ ID NO: 5290 - protein, 115 aa, Pisum sativum
MASFDEAPPGNPTAGDKIFRTKCAQCHTVDKGAGHKQGPNLNGLFGRQSGTTPGYSYSAANKNKAVNWDEKTLYDYLLNPKKYIPGTKMVFPGLKKPQDRADLIAYLKKATSSDE

SEQ ID NO: 5291 - protein, 114 aa, Arabidopsis lyrata
MASFDEAPPGNAKAGEKIFRTKCAQCHTVEQGAGHKQGPNLNGLFGRQSGTTAGYSYSAANKNKAVDWEEKTLYDYLLNPKKYIPGTKMVFPGLKKPQDRADLIAYLKESTGPK

SEQ ID NO: 5292 - protein, 114 aa, Arabidopsis thaliana [sequence omitted]

SEQ ID NO: 5293 - protein, 114 aa, Pseudotsuga menziesii
MASFSEAPPGDAKAGEKIFKTKCAQCHTVDKGAGHKQGPNLHGLFGRQSGTTAGYSYSAGNKNKAVIWGEDTLYEYLLNPKKYIPGTKMVFPGLKKPKERVDLIAYLKEATSSE

SEQ ID NO: 5294 - protein, 110 aa, Antirrhinum majus
FAEAPPGNKTAGEKIFKTKCAQCHTVDKGAGHKQGPNLNGLFGRQSGTTPGYSYSAANKSMAVIWEEKTLYDYLLNPKKYIPGTKMVFPGLKKPQDRADLIAFLKESTAN

SEQ ID NO: 5295 - protein, 113 aa, Persea americana
MATFEEAPPGDPKSGEKIFRTKCAQCHTVEKGAGHKQGPNLHGLFGRQSGTTPGYSYSTANKNMAVNWEEKTLYDYLLNPKKYIPGTKMVFPGLKKPKERADLIAYLKESTSS

SEQ ID NO: 5296 - protein, 113 aa, Gnetum gnemon
MATFAEAPGGDAKVGEKIFKTKCAQCHTVDKGAGHKQGPNLNGLFGRQSGTATGYSYSSANKNKAVVWGEETLYEYLLNPKKYIPGTKMVFPGLKKPQERADLIAYLKKSTAE

SEQ ID NO: 5297 - protein, 113 aa, Lotus japonicus
MATFDEAPPGDTKAGEKIFKIKCAQCHTVDQGAGHKQGPNLNGLFGRQSGTTPGYSYSAANKNMAVIWEEKTLYDYLLNPKKYIPGTKMVFPGLKKPQDRADLIAYLKQSTAQ

SEQ ID NO: 5298 - protein, 113 aa, Glycine max
MASFDQAPPGDVKSGDKIFRTKCAQCHTVEKGAGHKQGPNLNGLFGRQSGTTPGYSYSSANKNMAVTWEEKTLYDYLLNPKKYIPGTKMVFPGLKKPQERADLIAYLKESTAQ

SEQ ID NO: 5299 - protein, 113 aa, Triphysaria pusilla
MASFTEAPPGNAKAGEKIFKLKCAQCHTVEQGAGHKQGPNLNGLFGRQSGTTAGYSYSAANKNKAVEWEEGALYDYLLNPKKYIPGTKMVFPGLKKPQDRADLIAYLKGATSA

SEQ ID NO: 5300 - protein, 137 aa, Rosa hybrid cultivar
FAEAPPGDAKAGEKIFKTKCAQCHTVDKAAGHKQGPNLNGLFGRQSGTTPGYSYSAANKSMAVNWEEKTLYDYLLNPKKYIPGTKMVFPGLKKPKERADLIAYLKESMHLKLPLFDLSHFAVTGGLYKLMSTIFCCQ

SEQ ID NO: 5301 - protein, 101 aa, Carthamus tinctorius
MPKLGRRYSKPSVLSAIVEKGSGHKQGPNLNGLFGRQSGTTAGYSYSAANENMAVIWGENTLYDYLLNPKKYIPGTKMVFPGLKKPQDRADLIAYLKQSTA

SEQ ID NO: 5302 - protein, 112 aa, Ambrosia trifida
MASFAEAPAGNPTVGEKIFKTKCAQCHTAEKGAGHKQGPNLNGLFGRQSGTTAGYSYSAGNKNKAVIWEENTLYDYLLNPKKYIPGTKMVFAGLKKPQDRADLISYLKQSTA

SEQ ID NO: 5303 - protein, 112 aa, Ambrosia trifida
MASFEEAPAGDAKVGEKIFKTKCAQCHTVVKAAGHKQGPNLNGLFGRQSGTTAGYSYSAANKNMAVIWEEKTLYEYLLNPKKYIPGTKMVFPGLKKPKDRADLIAYLKESTA

SEQ ID NO: 5304 - protein, 112 aa, Helianthus annuus
MASFEQAPAGDAKTGEKIFRTKCAQCHTVDKGAGHKQGPNLNGLFGRQSGTTAGYSYSAANKNMAVIWEEKTLYDYLLNPKKYIPGTKMVFPGLKKPKDRADLIAYLKQSTA

SEQ ID NO: 5305 - protein, 112 aa, Arnica chamissonis
MASFEQAPAGDAKVGEKIFKTKCAQCHTVEKGAGHKQGPNLNGLFGRQSGTTAGYSYSAANKNMAVVWGENTLYDYLLNPKKYIPGTKMVFPGLKNQRIRADLIAYLKQSTA

SEQ ID NO: 5306 - protein, 112 aa, Manihot esculenta
MATFEQAPPGDAKSGEKIFKTKCAQCHTVDKGAGHKQGPNLNGLFGRQSGTTPGYSYSAANKNMAVIWEESTLYEYLLNPKKYIPGTKMVFPGLKKPQDRTDLIAYLKNATA

SEQ ID NO: 5307 - protein, 112 aa, Vigna unguiculata
MASFDEAPPGNSKNGEKIFKIKCAQCHAVEKSGGHKQGPNLNGLFGRQSGTTPGYSYSTANKNMAVIWEEKTLYDYLLNPKKYIPGTKMVFPGLKKPQDRADLIAYLKESTA

SEQ ID NO: 5308 - protein, 112 aa, Cryptomeria japonica
MATFEEAPPGNEKSGEKIFKTKCAQCHTVDKGAGHKQGPNLNGLFGRQSGTTAGYSYSAANKSKAVIWGEDTLYEYLLNPKKYIPGTKMVFPGLKKPQDRVDLIAYLKQSTS

SEQ ID NO: 5309 - protein, 112 aa, Sequoia sempervirens
MASFSEAPPGDEKAGEKIFKTKCAQCHTVDKGAGHKQGPNLNGLFGRQSGTTTGYSYSAANKSKAVIWGEDTLYEYLLNPKKYIPGTKMVFPGLKKPQDRVDLIAYLKKSTS

SEQ ID NO: 5310 - protein, 117 aa, Utricularia gibba
MASFDEAPPGDQKSGEKIFKTKCAQCHTVDKGAGHKQGPNLNGLFGRQSGTTPGYSYSAANKNMAVIWEEKTLYDYLLNPKKYIPGTKMVFPGLKKPQERADLISYLKAATADAGSS

SEQ ID NO: 5311 - protein, 113 aa, Glycine max
MASFDQAPPGDVKSGDKIFRTKCAQCHTVEKGAGHKQGPNLNGLFGRQSGTTPGYSYSSANKNMAVTWEEKTLYDYLLNPKKYIPGTKMVFPGLKKPQERADLIAYLRESTAQ

SEQ ID NO: 5312 - protein, 112 aa, Cephalotaxus harringtonia
MASFTEAPPGDEKAGEKIFKTKCAQCHTAEKGAGHKQGPNLNGLFGRQSGTTAGYSYSTANKTKAVTWGEDTLYEYLLNPKKYIPGTKMVFPGLKKPQDRSDLVAYLKKATS

SEQ ID NO: 5313 - protein, 112 aa, Unknown
  Sequence found in Organisms: Euphorbia peplus, Euphorbia esula
MASFDQAPPGDSKSGEKIFRTKCTQCHTVEQGGGHEQGPNLNGLFGRQSGTMPGYSYSSANKNMAVGWGENTLYDYLLNPKKYVPGTKMVFPGLKKPQERADLIAYLKEATA

SEQ ID NO: 5314 - protein, 110 aa, Sequoia sempervirens
SFEEAPPGNEKTGEKIFKTKCAQCHTVEKGAGHKQGPNLTGLFGRQSGTTAGYSYSAANKSKAVIWGEDTLYEYLLNPKKYIPGTKMVFPGLKKPQDRADLIAYLKQATS

SEQ ID NO: 5315 - protein, 114 aa, Pinus pinaster
MATFSEAPPGDAKVGEKIFKTKCAQCHTVDKGAGHKQGPNLHGLFGRQSGTTAGYSYSAGNKNKAVIWGEDTLYEYLLNPKKYIPGTKMVFPGLKKPQERADLIAYLKQSTSSG

SEQ ID NO: 5316 - protein, 114 aa, Pinus taeda
MATFSEAPPGDAKAGEKIFKTKCAQCHTVDKGAGHKQGPNLHGLFGRQSGTTAGYSYSAGNKNKAVIWGEDTLYEYLLNPKKYIPGTKMVFPGLKKPQERADLIAYLKQIVRVV

SEQ ID NO: 5317 - protein, 113 aa, Adiantum capillus-veneris
MATFSEAPAGNPKAGEKIFKTKCSQCHVVEKGAGHRQGPNLNGLLGRQSGTTAGYSYSAANKNKAVVWGEETLYEYLLNPKKYIPGTKMVFPGLKKPQDRADLIAYLKESTQE

SEQ ID NO: 5318 - protein, 113 aa, Marchantia polymorpha
MATFAEAPAGNVKAGEKIFKTKCAQCHAVEKAAGHKQGPNLSGLLGRTSGTTAGYSYSAANKNKAVVWGDETLYEYLLNPKKYIPGTKMVFPGLKKPQERADLIAYLKENANA

SEQ ID NO: 5319 - protein, 113 aa, Phaseolus vulgaris
MASFDLAPPGDVKSGDKIFRTKCAQCHTVEKGAGHKQGPNLNGLFGRQSGTTPGYSYSSANKNMAVTWEEKTLYDYLLNPKKYIPGTKMVFPGLKKPQERSDLIAFLKESTAQ

SEQ ID NO: 5320 - protein, 112 aa, Bupleurum chinense
MASFAEAPPGNKDSGAKIFKTKCAQCHTVEQGQGHKQGPNLNGFFGRQSGTTPGYSYSAANKGKAVIWEENTLYDYLLNPKKYIPGTKMVFPGLKKPQDRTDLIAYLKEATS

SEQ ID NO: 5321 - protein, 104 aa, Euphorbia peplus
PGDAKAGEKIFKTKCAQCHTVDQGAGHKQGPNLNGLFGRQSGTTAGYSYSAANKNKAVAWGEDTLYDYLLNPKKYIPGTKMVFPGLKKPQDRADLIAYLKGATA

SEQ ID NO: 5322 - protein, 112 aa, Triticum aestivum
MASFGEAPAGNAASGEKIFKTKCAQCHTVERGGAHKQGPNLSGLFGRQSGTTAGYAYSTANKSMAVVWEENTLYDYLLNPKKYIPGTKMVFPGLKKPQERADLIAYLKKSTA

SEQ ID NO: 5323 - protein, 115 aa, Utricularia gibba
SFDEAPPGDQKSGEKIFKTKCAQCHTVDKGAGHKQGPNLNGLFGRQSGTTPGYSYSAANKNMAVIWEEKTLYDYLLNPKKYIPGTKMVFPGLKKPQERADLISYLKAATADAGTS

SEQ ID NO: 5324 - protein, 114 aa, Cedrus atlantica
MATFSEAPPGDSKAGEKIFKTKCAQCHTAEKGAGHKQGPNLHGLFGRQSGTTAGYSYSAGNKNKAVVWGEDTLYEYLLNPKKYIPGTKMVFPGLKKPQDRADLIAYLKKATSSE

SEQ ID NO: 5325 - protein, 114 aa, Podocarpus macrophillus
MATFAEAPPGDPKAGEKIFKTKCAQCHTVEKGAGHKQGPNLHGLFGRQSGTTPGYSYSAGNKNKAVIWNEETLYEYLLNPKKYIPGTKMVFPGLKKPKERTDLIAYLKQATSSE

SEQ ID NO: 5326 - protein, 113 aa, Picea glauca
MSTFSEAPPGDTKVGEKIFKMKCAQCHTVDKGAGHKQGPNLHGLFGRQSGTTAGYSYSAGNKNKAVVWGEDTLYEYLLNPKKYIPGTKMVFPGLKKPQERADLIAYLKQASSS

SEQ ID NO: 5327 - protein, 113 aa, Abies balsamea
MATFSEAPPGDSKAGAKIFKTKCAQCHTAEKGAGHKQGPNLHGLFGRQSGTTAGYSYSAGNKNKAVIWGEDTLYEYLLNPKKYIPGTKMVFPGLKKPQERADLIAHLKKATSE

SEQ ID NO: 5328 - protein, 113 aa, Phaseolus vulgaris
MASFDLAPPGDVKSGDKIFRTKCAQCHTVEKGAGHKQGPNLNGLFGRQSGTTPGYSYSSANKNMAVTWEEKTLYDYLLNPKKYIPGTKMVFPGLKKPQDRSDLIAFLKESTAQ

SEQ ID NO: 5329 - protein, 113 aa, Picea glauca
MSTFSEAPPGDTKVGEKIFKMKCAQCHTVDKGAGHKQGPNLYGLFGRQSGTTAGYSYSAGNKNKAVVWGEDTLYEYLLNPKKYIPGTKMVFPGLKKPQERADLIAYLKQASSS

SEQ ID NO: 5330 - protein, 60 aa, Lactuca sativa
MLKEKIPPPARFSIYTDRWRRIAEALQQETPPLREKIFQTKCAQCHTVQKGAGHKQGPRS

SEQ ID NO: 5331 - protein, 112 aa, Hordeum vulgare
MASFGEAPAGNAAGGEKIFKTKCAQCHTVERGGAHKQGPNLSGLLGRQSGTTAGYAYSTANKNMAVVWEEKTLYDYLLNPKKYIPGTKMVFPGLKKPQERADLIAYLKQSTA

SEQ ID NO: 5332 - protein, 111 aa, Euphorbia peplus
ASFEQAPAGDAKSGDKIFRTKCAQCHTVEQGGGHKQGPNLNGLFGRQSGTMPGYSYSSANKNMAVGWGDHTLYDYLLNPKKYIPGTKMVFPGLKKPQERADLIAYLKEATA

SEQ ID NO: 5333 - protein, 115 aa, Podocarpus macrophillus
MAATFSEAPPGNEKSGEKIFKTKCAQCHTVEKGQGHKQGPNLNGLFGRQSGTTAGYSYSAANKNKAVIWGEDTLYEYLLNPKKYIPGTKMVFPGLKKPQDRTDLIAYLKKATSSD

SEQ ID NO: 5334 - protein, 112 aa, Setaria italica
MASFAEAPAGDAGSGEKIFRTKCAQCHTVERGGAHKQGPNLHGLFGRQSGTTLGYAYSTANKNMAVVWGEGTLYDYLLNPKKYIPGTKMVFPGLKKPKERTDLIAYLKESTA

SEQ ID NO: 5335 - protein, 112 aa, Beta vulgaris
MATFSEAPAGNKDGGAKIFKMKCAQCHTVEQGAGHKQGPNLNGLFGRQSGTAAGYSYSAANKNKAVVWGEDTLYEYLLNPKKYIPGTKMVFPGLKKPQDRADLIAYLKESTQ

SEQ ID NO: 5336 - protein, 104 aa, Glycyrrhiza uralensis
MASFDQAPPGDVKSGEKIFKTKCAQCHTVEKGAGHKQGPNLNGLFGRQSGTTPGYSYSAANKNMAVTWEEKTLYDYLLNPKKYIPGTKMVFPGLKKPQERADLI

SEQ ID NO: 5337 - protein, 111 aa, Marchantia polymorpha
MATFGDAPAGNAKAGEKIFKTKCAQCHAVEKSAGHKQGPNLSGLLGRTSGTTAGYSYSAANKNKAVVWGEDTLYEYLLNPKKYIPGTKMVFPGLKKPQERADLIEYLKDAT

SEQ ID NO: 5338 - protein, 113 aa, Physcomitrella patens
MATFAEAPKGNEKAGEKIFKTKCAQCHAVEKSAGHKQGPNLNGLFGRTSGTTAGYTYSKANKDKAVVWDEEQLYEYLLNPKKYIPGTKMVFPGLKKPQERADLIAYLKSSTSS

SEQ ID NO: 5339 - protein, 113 aa, Pteridium aquilinum
MATFADAPPGDVKAGEKIFKTKCSQCHVVEKGAGHRQGPNLHGLLGRQSGTTPGYSYSNANKSKAVVWSEEHLYEYLLNPKKYIPGTKMVFPGLKKPKERADLIAYLKEATAE

SEQ ID NO: 5340 - protein, 113 aa, Zostera marina
MASFAEAPPGDAANGAKIFKTKCAQCHTVEKGASHKQGPNLNGLFGRQSGTAPGYSYSAANKNKAVIWEENTLYDYLLNPKKYIPGTKMVFPGLKKPQERTNLIAFLKDSTSA

SEQ ID NO: 5341 - protein, 81 aa, Pteridium aquilinum
KGRREDFQDQVRPVPHRRERCRSQARPNLNGLFGRQSGTTPGYSYSAANKNMAVNWEEKTLYDYLLNPKKYIPGKKWFSLD

SEQ ID NO: 5342 - protein, 102 aa, Flaveria ramosissima
MASFAEAPAGNATAGEKIFKTKCAQCHTVEKGAGHKQGPNLNGLFGRQSGTTAGYSYSAANKSKAVTWEENTLYDYLLNPKKYIPVTKMVFPGLKKPQERAD

SEQ ID NO: 5343 - protein, 106 aa, Secale cereale
MASFSEAPPGNPASGEKIFKTKCAQCHTVDKGAGHKQGPNLNGLFGRQSGTTPGYSYSTANKLMAVNWEEKTLYDYLLNPKKYIPGTKMVFPGLKKPRSVLISSHT

SEQ ID NO: 5344 - protein, 113 aa, Ceratodon purpureus
MASFAEAPKGNEKAGEKIFKTKCAQCHVVEKGAGHKQGPNLHGLFGRTSGTTAGYAYSKANKDKAVDWNEEHLYEYLLNPKKFIPGTKMVFPGLKKPQERADLISYLKKSTSE

SEQ ID NO: 5345 - protein, 113 aa, Physcomitrella patens
MASFAEAPKGNEKAGEKIFKTKCAQCHAVEKSAGHKQGPNLHGLFGRTSGTTAGYTYSKANRDKAVDWNEEHLYEYLLNPKKYIPGTKMVFPGLKKPQERADLIAYLKKSTSE

SEQ ID NO: 5346 - protein, 118 aa, Epimedium sagittatum
INHKHHLHALPQPHLRSKAGEKIFKTKCAQRHTVQQGAGHKQGPNLNGLFGRQSGTTGGYSYSAANKNMAVIWEEKTLYDYLLNPKKYIPGTKMVFPGLKKPQDRADLIAYLKEATSS

SEQ ID NO: 5347 - protein, 105 aa, Distylium racemosum
GDQKAGEKIFKTKCAQCHTVDKGAGHKQGPNLNGLFGRQSGTTAGYSYSAANKNKAVVWGEDTLYEYLLNPKKYIPGTKMVFPGLKKPQDRADLIAFLKKSTSEE

SEQ ID NO: 5348 - protein, 112 aa, Oryza sativa
MASFGVAPVGNAASGKKIFRTKCAQCHTVERGGAHKQGPNLHGLFGRQSGTTPGYAYSTANKNMAVVWEEGTLYDYLLNPKKYIPGTKMVFPGLKKPQERTDLIAYLKESTA

SEQ ID NO: 5349 - protein, 63 aa, Secale cereale
VPPAEGSPTLPSPATVRAGSAAATMASFSEAPRDRRPARRSSDQVRPRATPSTRRPATSKGLT

SEQ ID NO: 5350 - protein, 113 aa, Picea glauca
MSTFSEAPPGDTKVGEKIFKMKCAQCHTVDKGAGHKQGPNLYGLFGRQSGTTAGYSYSAGNKNKAVVWGEDTLYEYLLNPKKYIRGNMIVIPGLKKPQERADLIAYLKQATSS

SEQ ID NO: 5351 - protein, 113 aa, Pennisetum glaucum
MAASFAEAPAGDAGSGEKIFRTKCAQCHTVERGGAHKQGPNLHGLFGRQSGTTLGYAYSTANKNMAVVWEEGTLYDYLLNPKKYIPGTKMVFPGLKKPKERTDLIAYLKESTA

SEQ ID NO: 5352 - protein, 113 aa, Physcomitrella patens
MATFAEAPKGNDKAGEKIFKTKCAQCHAVEKAAGHKQGPNLHGLFGRTSGTTPGYAYSKANKDKAVEWEEEKLYEYLLNPKKYIPGTKMVFPGLKKPQERADLIAYLKKSTSE

SEQ ID NO: 5353 - protein, 95 aa, Vinca minor
MASFAEAPPGNPKAGEKIFKTKCAQCHTVDKGAGHKQGPNLNGLFGRQSGTTSGYSYSAANKNMAVIWEEKTLYDYLLNPKKYIPGTKMVFPGLK

SEQ ID NO: 5354 - protein, 113 aa, Picea glauca
MSTFSEAPPGDTKVGEKIFKMKCAQCHTVDKGAGHKQGPNLHGLFGRQSGTTAGYSYSAGNKNKAVVWGEDTLYEYLLNPKKYIRGNMIVIPGLKKPQERADIIAYLKQATSS

SEQ ID NO: 5355 - protein, 517 aa, Solanum phureja
MAFQGSFWAISLLIFLANFLSMIEFSLAANAKVPSHTISNPFNRTIFSPDFLFGASTSSYQYEGAWNEDGKGPSIVDTFVHTHPEKILDRSNGDIALDFYHRYKEDVKLAKFEGLDAFRISIAWTRILPEGQVKKGVNQAGIDHYNSLINEIVALGIKPLVTLFHWDLPQALEDEYLGFLSRKIVDDYVDFVEICFKNFGDRVKLWATMNEPWIFTSTGYDSGSLAPGRCSAWMNSNCTIGNSGTEPYIAGHNILLAHAAASKLYRKKYKPIQKGQIGTIVVSHWFEPASNKPQDKKASIRALDFMLGWFMHPLTYGDYPISMRKLVGKRLPKFTPKESMLVKDSCDFIGLNYYTSNFAAHISNPPNTVNISSGTDNLVNQTTSRNGKLIGDPTGVSIFYVAPKGLYKLLVYIKKFYKNPIVYITECGMGESNIDDVAKGINDAQRVDFYQRHIKALYRAFREGVHVKGFFAWSFFDNFEWGSGYTQRFGINFVDYKNNLKRYPKRSALWMKKFLLK

SEQ ID NO: 5356 - protein, 492 aa, Solanum tuberosum
AFQGSFWAISLLILLANFLSMIEFSLAANAKVPSHTISNPFNRTIFSPDFLFGASTSSYQYEGAWNEDGKGPSIVDTFVHTHPEKILDRSNGDIALDFYHRYKEDVKLAKFEGLDAFRISIAWTRILPKGQVKKGVNQAGIDHYNSLINEIVALGIKPLVTLFHWDLPQALEDEYLGFLSPKIVDDYVDFVEICFKNFGDRVKLWATMNEPWIFTSTGYDSGSLAPGRCSAWKNNNCTIGNSGTEPYIAGHNILLAHAAASKLYRKKYKPIQKGQIGTIVVSHWFEPASNKPQDKKASIRALDFMLGWFMHPLTYGDYPISMRKLVGKRLPKFTPKESMLVKDSCDLIGLNYYTSNFAAHISKPPNTVNISSGTDNLVNQTTSRNGKLIGDPTGVSIFYVAPKGLYKLLVYIKKFYKNPIVYITECGMGESNIDDVAKGINDAQRVDFYQRHIKALYRALGKEYMLRGSLHGHFLTTLNGDQDTHRDLASIL

SEQ ID NO: 5357 - protein, 515 aa, Capsicum annuum
MASKGPFLAVGLLIFLATFLATAEFSVAAKVPSRTISTPFNRTIFPSSFLFGASTSSYQYEGAWNEDGKGPSIIDTFVHTHPEKILDRSNGDIALDFYHRYKEDVKLAKFEGLDAFRFSIAWTRILPKGKLSKGVNQAGIDHYNSLINEIVALGIKPLATLFHWDVPQALEDEYLGFLSPKIVGDYTDFVEICFKHFGDRVKLWSTMNEPWIFTSTGYDSGSLAPGRCSAWMNSNCSAGNSGTEPYIAGHNILLAHAAAAKLYRQKYKPIQKGEIGIILVSHWFEPFSNKPEDKRASKRSLDFMLGWYLHPLTYGDYPRTMKRLVGKRLPKFTPKESKLVKDSFDFLGLNYYTSNFAAHLSSPPNTVNISSGTDNQVNQTIPRNGKFIGDPTGVSIFYVAPKGLYKILVYMKKYYNNPPVYVTECGMGESNIDDVARGTNDVQRVDFYKRHITALHRSFREGVNVKAFFAWSFFDNFEWGSGYTQRFGINFIDYKNNLKRYPKRSALWMKRFLLK

SEQ ID NO: 5358 - protein, 81 aa, Solanum phureja
MYMKHLIEVVDPHKKLIKWKVIEGDLLELYNYCNFTTSCELQWTTWTIEYEKKTEDTPEPLLHLGVILAMTKDIENHLLKK

SEQ ID NO: 5359 - protein, 144 aa, Solanum phureja
MGLKGKLIASMEMKCGEGSFFDIFHTSTHQVPNISTRNIVHFEIHEGEIVKTGSIVSWKYNQAGQEMYMKQLIEAHKKLIKWKVIEGDLLELYNYCNFTTSCEREWTTWTIEYEKKTEDTPEPLLHLGVILAMTMDIENHLLKK

SEQ ID NO: 5360 - protein, 147 aa, Solanum tuberosum
MGLKGKLIASMEMNCGGGSFFDIFHTSTHQVPNISPRTIVHFEIHEGETVKTGSIVSWKYIEAGQDKYMKHLIEAIDPHKKLIKWKVIEGDLLELYNYFDYTTSCDHQWTTWTIEYEKKTEDTPEPLIHFGNILDMTKDIEGHLLQK

SEQ ID NO: 5361 - protein, 166 aa, Solanum phureja
MQNQQQLQTLMQAGQISGSLSFNGNLSKEDEEMSKSALSTFKAKEEEIEKKKLEVKEKVQAQLGRIEEETRRLAIIREELEALGDPMKKEVSTVRKRIDIVNKELKPLGQTCQKKEREYKEALEAFNEKHKEKVQLITRLMELVGESEKMRMKKLEELSKSVETIR

SEQ ID NO: 5362 - protein, 156 aa, Solanum melongena
MQAGQISGSLSFNGNLSKEDEEMSKSALSTFKAKEEEIEKKKLEVKEKVQAQLGRIEEETRRLAIIREELEALADPMKKEVSTVRKRIDIVNKELKPLGQTCQKKEREYKEALEAFNDKHKEKVQLISRLMELVGESEKMRMKKLEELSKSVETIH

SEQ ID NO: 5363 - protein, 172 aa, Petunia hybrida
MQTQENMQNQQQLQTLMQSGQMSGSLSFNGTMSKEDEEMSKSALSTFKAKEEEIEKKKLEVKEKVQAQLGRIEEETRRLAIIREELEGLADPMKKEVSTVRKRIDAVNKELKPLGQTCQKKEREYKESLEAFNEKHKEKVQLISRLMELVGESEKMRMKKLEELSKSIETIH

SEQ ID NO: 5364 - protein, 130 aa, Gerbera hybrid cultivar
MQAGQISGSLSFNGLMTKEDEEMSRSALSTFKAKEEEIEKKKLEVRERVQAQLGRIEEETRRLATIREELEALTDPMKKEVSVVRKKIDSVNKELKPLGQNCQKKEREYKEALDAFNEKNKEKVQLITRS

SEQ ID NO: 5365 - protein, 171 aa, Coffea canephora
MTQTQRQGSEQLQTLMQSGQISGSLSFNGTLSREDEEMSKSALSTFRAKEEEIEKKKLEVKEKVQAQLGRIEEETKRLATIREELEALADPMKKEVSVVRKKIDAVNKELKPLGQTCQKKEKEYKEALEAFNEKNKEKVQLISRLMELVGESEKLRMKKLEELSKSIETIR

SEQ ID NO: 5366 - protein, 170 aa, Solanum lycopersicum
MPNQKQGSEQLQTLMQSGQISGSFSFNGTLSKEDEEMSRSALSTFKAKEEEIEKRKMEVKERVQAQLGRVEEETRRLAIIREELEALADPMKKDVQTVRKRIDAVNKELKPLGQTCQKKEKEYKEALEAFNEKHKEKVQLISRLMELVGESEKMRLKKLEELSKSIETIQ

SEQ ID NO: 5367 - protein, 171 aa, Solanum melongena
MPNQKQGGGEQLQTLMQSGQISGTFSFNGSLSKEDEEMSRSALSTFKAKEEEIEKRKMEVRERVQAQLGRVEEETRRLAIIREELEALADPMKKDVQTVRKKIDAVNKELKPLGQTCQKKEREYKEALEAFNEKHKEKVQLITRLMELVGESEKLRLKKLEELSKSVETIH

SEQ ID NO: 5368 - protein, 172 aa, Tabernaemontana elegans
MAQPPQRQQSEQLQTLMQSGQISGSLSFNGTLSKEDEEMSKSALSTFRAKEEEIEKKKLEVKEKVQAQLGRIEEETKRLATIREELEALADPMKKEVSLVRKKIDAVNKELKPLGQTCQKKEREYKEALEAFNEKNKEKVQLITRLMELVSESERMRMKKLEELSKSIETIR

SEQ ID NO: 5369 - protein, 170 aa, Unknown
  Sequence found in Organisms: Solanum tuberosum, Solanum phureja
MPNQKQGSEQLQTLMQSGQISGSFSFNGTLSKEDEEMSRSALSTFKAKEEEIEKRKMEVRERVQAQLGRVEEETRRLAIIREELETLADPMKKDVSTVRKRIDVVNKELKPLGQTCQKKEKEYKEALEAFNEKHKEKVQLISRLMELVGESEKMRLKKLEELSKSIETIQ

SEQ ID NO: 5370 - protein, 180 aa, Vinca minor
MATQQPPPQPPPPQRQQSEQLQTLMQSGQISGSFSFNGTMTKEDEEMSRSALSSFKAKEEEIEKKKLEVKEKVQAQLGRIEEETKRLATIREELESLADPMKKEVSLVRKKIDAVNKELKPLGQTCQKKEREYKESLEAFNEKNKEKVALITRLMELVGESERMRMKKLEELSKSVETVR

SEQ ID NO: 5371 - protein, 172 aa, Amsonia hubrichtii
MAQPPQRQQSEQLQTLMQSGQISGSLSFNGTLTKEDEEMSKSALSTFRAKEEEIEKKKLEVKEKVQAQLGRIEEETKRLATIREELEALADPMKKEVSMVRKKIDSVNKELKPLGQTCQKKEREYKEALEAFNEKNKEKVQLITRLMELVSESERMRMKKLEELSKSIETIR

SEQ ID NO: 5372 - protein, 172 aa, Catharanthus roseus
MAQPPQRQQSEQLQTLMQSGQISGSLSFNGTLSKEDEEMSRSALSTFKAKEEEIEKKKLEVKERVQAQLGRIEEETKRLANIREELEALADPMKKEVSLVRKKIDSVNKELKPLGQTCQKKEREYKEALEAFNEKNREKVQLITRLMELVSESERMRMKKLEELSKSIETIR

SEQ ID NO: 5373 - protein, 156 aa, Lactuca sativa
MQAGQISGSLSFNGLMTKEDEEMSRSALSTFKAKEEEIEKKKLEVRERVQAQLGRIEEETRRLASIREELEALTDPMKKEVSVVRKRIDTVNKELKPLGQTCQKKEREYKEALDAFNEKNKEKVQLITRLMELVSESEKMRMKKLEELSKSVETIQ

SEQ ID NO: 5374 - protein, 156 aa, Lactuca sativa
MQAGQISGSLSFNGLMTKEDEEMSRSALSTFKAKEEEIEKKKLEVRERVQAQLGRIEEETRRLATIREELEALTDPMKKEVSVVRKRIDTVNKELKPLGQTCQKKEREYKEALDAFNEKNKEKVQLITRLMELVSESEKMRMKKLEELSKSVETIQ

SEQ ID NO: 5375 - protein, 156 aa, Helianthus annuus
MQAGQISGSLSFNGLMSKEDEEMSRSALSTFKAKEEEIEKKKLEVRERVQAQLGRIEEETRRLATIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5376 - protein, 156 aa, Artemisia annua
MQAGQISGSLSFNGLMTKEDEEMSKSALSTFKAKEEEIEKKKLEVRERVQAQLGRIEEETRRLASIREELEALTDPMKKEVSVVRKKIDSVNKELKPLGQTCQKKEREYKEALDAFNEKNKEKVQLITRLMELVSESEKMRMKKLDELSKSVETIQ

SEQ ID NO: 5377 - protein, 156 aa, Unknown
  Sequence found in Organisms: Cichorium intybus, Senecio madagascariensis, Tragopogon dubius
MQAGQISGSLSFNGLMTKEDEEMSRSALSTFKAKEEEIEKKKLEVRERVQAQLGRIEEETRRLATIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5378 - protein, 156 aa, Cynara scolymus
MQAGQISGSLSFNGLMTKEDEEMSRSALSTFKAKEEEIEKKKLEVRERVQAQLGRIEEETRRLANIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5379 - protein, 156 aa, Taraxacum officinale
MQAGQISGSLSFNGLMTKEDEEMSRSALSTFKAKEEEIEKKKLEVRERVQAQLGRIEEETKRLASIREELEALTDPMKKEVSVVRKRIDSVNKELKPLGQTCQKKEREYKEALDAFNEKNKEKVQLITRLMELVSESEKMRMKKLEELSKSVETIQ

SEQ ID NO: 5380 - protein, 172 aa, Sesamum indicum
MMQTQRTLENQQSLMQSGQISGSLSFNGTLSKEDEEMSKSALSTFRAKEEEIEKKKMEVKEKVQAQLGRIEEETKRLATIREELEALADPMKKEVSLVRKKIDAVNKELKPLGQTCQKKEREYKEALEAFNEKNKEKVQLITRLMELVSESERLRLKKLEELSKNIETIRSA

SEQ ID NO: 5381 - protein, 172 aa, Cynara scolymus
MATQTEKQSSEQLQTLMQAGQISGSLSFSGLMSKEDEEMSKSALSTFKAKEEEIEKKKLEVKERVQAQLGRIEEETRRLASIQEELEALTDPMKKEVSVVRKKIDSVNKELKPLGQTCQKKEREYKEALDAFNEKNKDKVQLITRLMELVGESEKTRMKKLDELSKSIETIQ

SEQ ID NO: 5382 - protein, 176 aa, Lactuca sativa
MTTQTQVQTQRQSSEQLQTLMQAGQISGSLSFNGLMTKEDEEMSRSALSTFKAKEEEIEKKKLEVRERVQAQLGRIEEETRRLASIREELEALTDPMKKEVSVVRKRIDTVNKELKPLGQTCQKKEREYKEALDAFNEKNKEKVQLITRLMELVSESEKMRMKKLEELSKSVETIQ

SEQ ID NO: 5383 - protein, 170 aa, Parthenium argentatum
MATQNQPHEQLQTLMQAGQMSGSLSFSGLMSKEDEEMSKSALSTFKAKEEEIERKKLEVKERVQAQLGRIEEETRRLASIQEELDALTDPMKKEVTLVRKKIDTVNKELKPLGHTCQKKEREYKEALDAFNEKNKEKVQLITRLMELVSESEKERMKKLEELSKSIETIQ

SEQ ID NO: 5384 - protein, 169 aa, Nicotiana tabacum
MPNQKQGSEQLQTLMQSGQISGSLSFNGTLTKEDEEMSRSALSTFKAKEEEIEKKKMEVKERVQAQLGRVEEETRRLAIIREELEALADPKKKDVQIVRKKIDAVNKELKPLGQTCQKKEKEYKEALEAFNEKHKEKVQLITRLMELVGESEKLRLKKLELSKSIETIR

SEQ ID NO: 5385 - protein, 160 aa, Arnica chamissonis
MATQNQPHEQLQTLMQAGQISGSLSFSGLMSKEDEDMSKSALSAFKAKEEEIEKKKLEVKERVQAQLGRIEEETRRLAAIQEELEALTDPMKKEVTVVRKKIDSVNKELKPLGHNCQKKEREYKEALDAFNEKNKEKVQLITRLMELVSESEKEEDEEVG

SEQ ID NO: 5386 - protein, 157 aa, Centaurea maculosa
MQAGEMSGGSLSFSGLMSKEDEEMSKSALSTFKAKEEEIEKKKLEVKERVQAQLGRIEQETRRLASIQEELDALTDPMKKEVTLVRKKIDTVNKELKPLGHTCQKKEREYKEALDAFNEKNKEKVQLITRLMELVSESEKERMKKLEELSKSIETIQ

SEQ ID NO: 5387 - protein, 173 aa, Ipomoea nil
MQNQRQGGESQTQLQTLMQSGQISGSLSFNGTMTKEDEEMSRSALSTFKAKEEEIEKKKLEVREKVQAQLGRIEEETRRLATILEELEALADPMKKEVSLVRKKIDTVNKELKPLGQTCQKKEREYKEALEAFNEKHKEKVQLITRLTELVSESEKLRMKKLEELSKSIETLR

SEQ ID NO: 5388 - protein, 178 aa, Ambrosia trifida
MTTQTTSQAQTQRQSSEQLQTLMQAGQISGSLSFNGLMSKEDEEMSRSALSTFKAKEEEIEKKKLEVKERVQAQLGRIEEETRRLATIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5389 - protein, 172 aa, Cirsium arvense
MATQTQKQSTEQLQTLMQAGQISGSLSFSGLMSKEDEEMSKSALSTFKAKEEEIEKKKLEVKERVQAQLGRIEEETRRLASIQEELEALTDPMKKEVSVVRKKIDSVNKELKPLGQTCQKKEREYKEALDAFNEKNKEKVQLITRLMELLGESEKTRMKKLDELSKSIETVQ

SEQ ID NO: 5390 - protein, 176 aa, Unknown
  Sequence found in Organisms: Centaurea maculosa, Cirsium arvense
MSTIQTVQTQRQSSEQLQTLMQAGQISGSLSFNGLMTKEDEEMSRSALSTFKAKEEEIEKKKLEVRERVQAQLGRIEEETRRLANIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5391 - protein, 171 aa, Taraxacum officinale
MAQPQKQSSEQLQTLMQAGQISGSLSFSGLMSKEDEEMSKSALSSFKAKEEEIEKKKLEVKERVQAQLGRIEEETRRLASIQEELESLTDPMKKEVSVVRKKIDSVNKELKPLGQTCQKKEREYKEALDAFNEKNKEKVQLITRLMELVSESEKTRMKKLDELSKSIETIQ

SEQ ID NO: 5392 - protein, 176 aa, Parthenium argentatum
TTSQQQSQTQRQSSEQLQTLMQAGQISGSLSFNGLMSKEDEEMSRSALSTFKAKEEEIEKKKLEVRERVQAQLGKIEEETRRLATIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5393 - protein, 171 aa, Petunia hybrida
MLNQKQQGSEQLQTLMQSGQISGSFSFNGTLTKEDEEMSRSALSTFKAKEEEIEKKKMEVKERVQAQLGRIEEETKRLATIREELEALADPMKKEVQAVRKKVDAVNKELKPLGQTCQKKEREYKEALEAFNEKHKEKVQLITRLMELVSESEKQRLKKLEELSKSIETIR

SEQ ID NO: 5394 - protein, 168 aa, Valeriana officinalis
MTSENPQPQQTLMQAAQISGSLSFNGNLSKEEEEMSKSALSTFRAKEEEIEKKKLEVKERVLAQLGRIEDETRRLAGIREELEGLADPMKKEVALVRKKIDSVNKELKPLGQNCQKKEREYKEALDAFNEKNKEKVQLINKLMELVSESEKLRMKKLEELSKSIELMH

SEQ ID NO: 5395 - protein, 165 aa, Bupleurum chinense
MMQTQQQALMQSGQLSGSLSFSSNLSKEDEEMSKSALSTFRAKEEEIEKKKLEVRERVQAQLGRIEEETKRLANIREELEGLADPMKKEVSVVRKKIDSVNKELKPLGQTCQKKEKEYKDALEAFNDKNKEKVQLITRLMELVSESEKLRMKKLEELSKSIELTR

SEQ ID NO: 5396 - protein, 172 aa, Carthamus tinctorius
MASQNQKQSSEQLQTLMQAGQISGSLSFSGLMSREDEEMSKSALSTFKAKEEEIEKKKLEVKERVQAQLGRIEEETRRLASIQEEPEALTDPMKKEVSVVRKKIDSVNKELKPLGQTCQKKEREYKEALDAFNEKNKEKVQLITRLMELVGESEKTRMKKLDELSKSIETVQ

SEQ ID NO: 5397 - protein, 172 aa, Camellia sinensis
MTQTQRQASEQQQQALMQSGQISGSLSFNGTLTKEDEEMSRSALSTFRAKEEEIEKKKLEVKEKVQLHLGRIEEENRRLATIREELEGLADPMKKVVSVVRKKIDAVNKELKPLGVTCQKKEREYKEALEAFNEKNKEKVQLITRLRELVGESERLRMKKLEELSKSIETVR

SEQ ID NO: 5398 - protein, 177 aa, Flaveria ramosissima
MTTTQTQVQTQRQSSEQLQTLMQAGQISGSLSFNGLITKEDEEMSRSALSTFKAKEEEIERKKLEVKERVQAQLGRIEEETRRLATIREELEALTDPMKKEVSLVRKKIDSVNKELKPLGQTCQKKEREYKEALDAFNEKNKEKVQLITRLMELVSESEKMRMKKLEELSKSVETIQ

SEQ ID NO: 5399 - protein, 156 aa, Helianthus annuus
MQAGQISGSLSFNGLMSKEDEEMSRSALSTFKAQAEEIEKKKLEVRERVQAQLGRIEEETRRLATIREEREALTDPMKKEVSVVRKKIDSVNKEWKPLGQTCQKKEREYKEALDAFNEKNKEKVQLITRLMELVSESEKMRMKKLEELSKSVETIQ

SEQ ID NO: 5400 - protein, 165 aa, Ambrosia trifida
MATQNQQHEQLQTLMQAGQISGSLSFSGLMSKEDEEMSKSALSTFKAKEEEIERKKLEVKERVQAQLGKIEEETRRLASIQEELDALTDPMKKEVTLVRKKIDTVNKELKPLGHTCQKKEREYKEALDAFNEKNKEKVQLITRLMELVSESEKERMKKLEELSKS

SEQ ID NO: 5401 - protein, 172 aa, Gerbera hybrid cultivar
MAAQPQRQNSEQLQTLMQAGQMSTSVSFSGLMSKEDEEMSKSALSTFKAKEEEIEKKKLEVKERVQAQLGRIEEETRRLATIQEELEALTDPMKKEVSVVRKKIDSVNKELKPLGQTCQKKEREYKEAMDAFNEKNKEKVQLITRLMELVSESEKTRMKKLEELSKSIETTQ

SEQ ID NO: 5402 - protein, 172 aa, Capsicum annuum
MPNQKQGGGSEQLQTLMQSGQISGSFSFNGSLSKEDEEMSRSALSSFKAKEEEIEKRKMEVRERVQAQLGRVEEETRRLAIIREELEALSDPMKKDVQAVRKRIDTVNKELKPLGQTCQKKEKEYKEALEAFNEKHQEKVQLITKLMELVGESEKLRLKKLEELSKSIETIQ

SEQ ID NO: 5403 - protein, 172 aa, Lippia dulcis
MMQTQKTLENQQSLMQSGQISGTLSFNGSMTKEEEEMSKSALMTFRAKEEEIEKKKLEVKEKVQAQLGRIEEETKRLANIREELEALADPMKKEVSVVRKKIDSVNKELKPLGQTCQKKEREYKEALEAFNEKNKEKVQLITRLMELVSESERLRLKKLEELSKNIETIHIA

SEQ ID NO: 5404 - protein, 171 aa, Sarracenia psittacina
MIQTQRQASEQQQALMQSGQISGSLSFNGSLTREDEEMSNSALSTFRAKEEEIEKKKLEVKEKVQLQLGRIEEETKRLSNIREELEGLSDPMKKEVSLVRKKIDAVNKELKPLGHTCQKKEKEYKEALEAFNEKNKEKVQLLNRLMELVSESEKMRLKKLEELSKCIETIH

SEQ ID NO: 5405 - protein, 174 aa, Panax ginseng
CRNSNSERENDANSSTNSDAIGSNFWEFKLQWQPNQEEEEMSKSALSTFRAKEEEIEKKKLEVRERVQAQLGRIEEETRRLANIREELEALADPMKKEVGVVRKKIDAVNKELKPLGHTCQKKEKEYKDALEAFNEKNKEKVQLITRLMELVSESEKLRMKKLEELSKSIEVRR

SEQ ID NO: 5406 - protein, 177 aa, Cirsium arvense
MTTTQTQVQTQRQSSEQLQTLMQAGQISGSLSFNGLMTKEDEEMSRSALSTFKAKEEEIEKKKLEVRERVQAQLGRIEEETKRLANIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5407 - protein, 177 aa, Flaveria ramosissima
MTTTQTQVQTQRQSSEQLQTLMQAGQISGSLSFNGLITKEDEEMSRSALSTFKAKEEEIERKKLEVKERVQAQLGRIEEETRRLATIREELEALTDPMKKEVSLVRKKIDSVNKELKPLGQTCQKKEREYKEALDAFNEKNKEKVQLITRLMELVSESEKMRMKKLEELSKSVETVQ

SEQ ID NO: 5408 - protein, 177 aa, Flaveria ramosissima
MTTTQTQVQTQRQSSEQLQTLMQAGQISGSLSFNGLITKEDEEMSRSALSTFKAKEEEIERKKLEVKERVQAQMGRIEEETRRLATIREELEALTDPMKKEVSLVRKKIDSVNKELKPLGQTCQKKEREYKEALDAFNEKNKEKVQLITRLMELVSESEKMRMKKLEELSKSVETIQ

SEQ ID NO: 5409 - protein, 156 aa, Lactuca sativa
MQAGQISGSLSFSGLMSKEDEEMSKSALSTFKAKEEEIEKKKLEVKERVQAQLGRIEEETKRLASIQEELESLTDPMKKEVSVVRKKIDSVNKELKPLGQTCQKKEREYKEALDAFNEKNKEKVQLITRLMELVSESEKTRMKKLDELSKSIETIQ

SEQ ID NO: 5410 - protein, 180 aa, Helianthus annuus
MTTQTTSLQTTTTQRQPSEQLQTLMQAGQISGSLSFNGLMSKEDEEMSRSALSTFKAKEEEIEKKKLEVRERVQAQLGRIEEETRRLATIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5411 - protein, 180 aa, Helianthus annuus
MTTQTTSLQTTTTQRQSSEQLQTLMQAGQISGSLSFNGLMSKEDEEMSRSALSTFKAKEEEIEKKKLEVRERVQAQLGRIEEETRRLATIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5412 - protein, 179 aa, Centaurea maculosa
MSTIQTTQAVQTQRQSSEQLQTLMQAGQISGSLSFNGLMTKEDEEMSRSALSTFKAKEEEIEKKKLEVRERVQAQLGRIEEETRRLANIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5413 - protein, 179 aa, Carthamus tinctorius
MSTIQTTQVVQTQRQSSEQLQTLMQAGQISGSLSFNGLMTKEDEEMSRSALSTFKAKEEEIEKKKLEVRERVQAQLGRIEEETRRLANIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5414 - protein, 173 aa, Centaurea maculosa
MASQNPQKQTSEQLQTLMQAGQISGSLSFSGLMSKEDEEMSKSALSTFKAKEEEIEKRKLEVKERVQAQLGRIEEETRRLASIQEELEALTDPMKKEVSVVRKKIDSVNKELKPLGQSCQKKEREYKEALDAFNEKNKEKVQLITRLMELLGESEKTRMKKLDELSKSIETVQ

SEQ ID NO: 5415 - protein, 177 aa, Arnica chamissonis
MTTTQTQVQTQRQSSEQLQTLMQAGQISGSLSFNGLMNKEDEEMSRSALSTFKAKEEEIEKKKLEVRERVQAQLGRIEEETKRLATIREELEALTDPMKKEVTVVRKKIDSVNKELKPLGQTCQKKEREYKEALDAFNEKNKEKVQLITRLMELVSESEKMRMKKLEELSKSVETIQ

SEQ ID NO: 5416 - protein, 170 aa, Antirrhinum majus
  misc_feature (165)..(165): Xaa can be any naturally occurring amino acid
MSQKTLENQLSLTQSEQISGSLSFNGAMAKEDEEMSKSALSTFRAKEEEIEKKKLEVKERVQAQLGRIEEETRRLATIREELDGLADPMKKEVSVVRKKIDAINKDLKPLGQTCQKKEKEYKEALDAFNEKNREKVQLISRLMELVGESEKLRMKKLEELSKNIXTIHIA

SEQ ID NO: 5417 - protein, 171 aa, Lippia dulcis
MMQTQRTLENQQSMQSGQISGSLSFNGTLTKEDEEMSKSALSTFRAKEEEIEKKKMEVKEKVQAQLGRIEEETKRLAVIREELDALSDPMKKEVSFVRKKIDSVNKELKPLGQTCQKKEREYKEALEAFNDKNKEKVQLITKLMELVSESERMRLKKLEELSKNIETIRIA

SEQ ID NO: 5418 - protein, 171 aa, Scabiosa columbaria
MQTEKQACEQQQQTLMQAAQISGSLSFNGNLTKEEEEMSKSALSTFRAKEEEIEKKKLEVKERVLAQLGRIEDETKRLAGIREELEALADPMKKEVALVRKKIDSVNKELKPLGQTCQKKEKEYKDALEAFNEKNKEKVQLINRLMELVSESEKLRMKKLEELSKSVELMR

SEQ ID NO: 5419 - protein, 171 aa, Sarracenia psittacina
MQTQRQGGEQEQQALTQFGQISGNLSFNGTLTKEEEEMSKSVLSTFRAKEEEIEKKKLEVKERVQAQLGRIEEETKRLSNIREELEALADPMKKEVSLVRKKIDAVNKELKPLGHTCQKKEREYKEALEAFTEKNKEKVQLITRLMELVSESERLRMKKLEELSKSVETIR

SEQ ID NO: 5420 - protein, 181 aa, Helianthus annuus
MTTQTTSLQTTTTTQRQSSEQLQTLMQAGQISGSLSFNGLMSKEDEEMSRSALSTFKAKEEEIEKKKLEVRERVQAQLGRIEEETRRLATIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5421 - protein, 170 aa, Helianthus annuus
MATLNQPHEQLQTLMQASQMSGSFSFSGLMSKEDEEMSQSALSTFKAKEEEIEKKKLEVKERVQAQLGRIEEETRRLASIQEELDALTDPMKKEVTLVRKKIDTVNKELKPLGHTCQKKEREYKEALDAFNEKNKEKVQLITRLMELVSESEKERMKKLEELSKSIETIQ

SEQ ID NO: 5422 - protein, 169 aa, Lippia dulcis
MMQGTLENQQSMQSGQISGSLSFNGTLTKEDEEMSKSALSTFRAKEEEIEKKKMEVKEKVQAQLGRIEEETKRLAVIREELDALSDPMKKEVSGVRKKIDSINKELKPLGQTCQKKEREYKEALEAFNDKNKEKVQLITKLMELVSESERMRLKKLEELSKNIETIHIA

SEQ ID NO: 5423 - protein, 174 aa, Cichorium intybus
MATQTQPQKQSSEQLQTLMQAGQISGSLSFSGLMSKEDEEMSKSALSTFKAKEEEIEKKKLEVKERVQAQLGRIEEETKRLASIQEELESLTDPMKKEVSVVRKKIDSVNKELKPLGQTCQKKEREYKEALDAFNEKNKEKVQLITRLMELVSESEKTRMKKLDELSKSIETVQ

SEQ ID NO: 5424 - protein, 174 aa, Tragopogon dubius
MATQPQAQKQSSEQLQTLMQAGQISGSLSFSGLMSKEDEEMSKSALSTFKAKEEEIEKKKMEVKERVQAQLGRIEEETKRLASIQEELEALTDPMKKEVSVVRKKIDSVNKELKPLGQTCQKKEREYKEALDAFNDKNKEKVQLITRLMELVSESEKTRMKKLDELSKSIETIQ

SEQ ID NO: 5425 - protein, 182 aa, Helianthus annuus
MTTQTTSLQTTTTTTQRQSSEQLQTLMQAGQISGSLSFNGLMSKEDEEMSRSALSTFKAKEEEIEKKKLEVRERVQAQLGRIEEETRRLATIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5426 - protein, 182 aa, Helianthus annuus
MTTQTTSLQTTTTTTQRQSSEQLQTLMQAGQISGSLSFNGLMSKEDEEMSRSALSTFKAKEEEIEKKKLEVRERVQAQLGRIEEETRRLANIREELEALTDPMKKEVSVVRKKIDSVNKELKPLGQTCQKKEREYKEALDAFNEKNKEKVQLITRLMELVSESEKMRMKKLEELSKSVETIQ

SEQ ID NO: 5427 - protein, 181 aa, Helianthus annuus
MTTQTTSLQTTTTTQRQSSEQLQTLMQAGQISGSLSFNGLMSKEDEEMSRSALSTFKAKEEEIEKKKLEVRERVQAQLGRIEEETRRLATIREELEALTDPMKKEVSVVRKKIDSVNKELKPLGQTCQKKEREYKEALDAFNEKNKEKVQPITRLMELVSESEKMRMKKLEELSKSVETIQ

SEQ ID NO: 5428 - protein, 171 aa, Mimulus guttatus
MQTQKTLENQQSLMQVGQISGSLSFNGTLSKEDEEMSKSALSTFRAKEEEIEKKKMEVKEKVQAQLGRIEEETKRLATIREELEGLSDPMRKEVSVVRKKIDSVNKELKPLGLTCQKKEKEYKDALEAFNDKNKEKVQLITRLMELVSESERLRMKKLEELSKNIETIRMP

SEQ ID NO: 5429 - protein, 171 aa, Utricularia gibba
MQGQKTTESQQSLVQSGQLSGSLSFNGAVLKEDEEMSKSALLTFRAKEEEIEKRKLEVKEKVVAQLGRIEEETKRLATIREELDALADPMKKEVSLVRKKIDAVNKELKPLGQTCQKKEKEYKEALEAFNEKNKEKVQLITRLMELVGESERMRLKKLEELSKNIETMRVN

SEQ ID NO: 5430 - protein, 159 aa, Panax ginseng
MQSGQISGSLSFNGSLSQEEEEMSKSALSTFRAKEEEIEKKKLEVRERVQAQMGRIEEETKRLASIREELEALADPMKKEIGVVRKKIDVVNKELKPLGQTCQKKEKEYKDALDAFNEKNKEKVQLITRLMEVSNLVSESESLRMKKLDELSKSIETTH

SEQ ID NO: 5431 - protein, 169 aa, Orobanche aegyptiaca
MMQTQRTLESQQSVVQPGQISGSLSFNGKEDEEMSKSALSTFRAKEEEIEKKKMEVKEKVQVQLGRIEEETKRLSSIREELEALSDPMKKEVSVVRKKIDSINKELKPLGQTCQKKEREYKEALEAFNEKNKEKVQLITRLMELVSESERLRLKKLEELSKNIETIRMA

SEQ ID NO: 5432 - protein, 134 aa, Triphysaria pusilla
MQTQKTLENQQSLMQAGQISGGLSFNGTMTKEDEEMSKSALSTFRAKEEEIEKKKMEVKEKVQIQLGRIEEETKRLAVIREELEALADPMKKEVSVVRKKIDSVNKELKPLGQTCQKKEREYKEALEAFNEKYN

SEQ ID NO: 5433 - protein, 170 aa, Flaveria ramosissima
MATQNQTHEQLQTLMQAGEVSGTLSFSGLISKEDEDMSKSALSAFKAKEEEIEKKKLEVKERVQAHLGRIEQETRRLATIQEELEALTDPMKKEVTLVRKKIDSVNKELKPLGHNCQKKEREYKEALDAFNEKNKEKVQLITRLRELVSESEKERMKKLDELSKSIETIQ

SEQ ID NO: 5434 - protein, 157 aa, Centaurea maculosa
MQSGGQISGSLSFSGLMSKEDEEMSKSALSTFKAKEEEIEKKKLEVKERVQAQLGRIEEETRRLASIQEELETLTDPMKKEVSVVRKKIDSVNKELKPLGQSCQKKEREYKEALDAFNEKNKEKVQLITRLMELLGESEKTRMKKLDELSKSIETVQ

SEQ ID NO: 5435 - protein, 173 aa, Guizotia abyssinica
MTTTQTQVPIQKQSSEQLQTLMQAGQISGSLSFNGLMTKEDEEMSRSALSTFKAKEEEIEKKKLEVRERVQAQLGRIEEETRRLATIREELEALTDPMKKEVSVVRKKIDSVNKELKPLGQTCQKKEREYKEALDAFNEKNKEKVQLITRLMELVSESEKMKMKKLEELSKSV

SEQ ID NO: 5436 - protein, 108 aa, Flaveria ramosissima
MATPNQTHEQLQTLMQAGEVSGSLSFSGLISKEDEDMSKSALSAFKAKEEEIEKQKLEVKERVQAQLGRVEQETRRLATIQEELEALTDPMKKEVTLVVRRLIPSTRS

SEQ ID NO: 5437 - protein, 156 aa, Vinca minor
MQSGQVSGSLSFNGSMTKEDEEMSRSALSSFKAKEEEIEKKKLEVKERVQAQLGRIEEETKRLATIREELESLADPMKKEVSFIRKKVDAVNKELKPLGQTCQKKEREYKEALETFNEKNKEKVQLITRLMELVSESERMRMKKLEELSKSIETIR

SEQ ID NO: 5438 - protein, 175 aa, Cirsium arvense
MASSQNPQKQTSEQLQTLMQGGGQISGSLSFSGLMSKEDEEMSKSALSTFKAKEEEIEKKKLEVKERVQAQLGRIEEETRRLASIQEELETLTDPMKKEVSVVRKKIDSVNKELKPLGQSCQKKEREYKEALDAFNEKNKEKVQLITRLMELLGESEKTRMKKLDELSKSIETVQ

SEQ ID NO: 5439 - protein, 339 aa, Solanum phureja
MMNSERLANIALAGLSLAPLVVNVDPNLNVVLTACLTVFVGCYRSVKPTPPSETMSKEHAMRFPLVGSAMLLSLFLLFKFLSKDLVNAVLTCYFFVLGIAAFSATLLPSIKRFLPEKWNEDLVIWHFPYFRSLEFEFTRSQIVAAIPGTMFCVWYAKQKHWLANNVLGLAFSIQGIEMLSLGSFKTGAILLAGLFVYDIFWVFFTPVMVSVAKSFDAPIKLLFPTSDLKRPFSMLGLGDIVIPGIFVALALRFDVSRGKGPQYFKSAFSGYAVGVISTIIVMNWFQAAQPALLYIVPAVIGFLAVHCIWNGDVKPLLEFDESKTQSTEEVAAEESKKVE

SEQ ID NO: 5440 - protein, 274 aa, Solanum tuberosum
MMNSERLANIALAGLSLAPLVVNVDPNLNVVLTACLTVFVGCYRSVKPTPPSETMSKEHAMRFPLVGSAMLLSLFLLFKFLSKDLVNAVLTCYFFVLGIAAFSATLLPSIKRFLPEKWNEDLIIWHFPYFRSLEFEFTRSQIVAAIPGTMFCVWYAKQKHWLANNVLGLAFSIQGIEMLSLGSFKTGAILLAGLFVYDIFWVFFTPVMVSVAKSFDAPIKLLFPTSDLKRPFSMLGLGDIVIPGIFVALALRLMSPEGRGLNTLKVHFRDMQLV

SEQ ID NO: 5441 - protein, 339 aa, Capsicum annuum
MKNSERIANVALAGLSLAPLVVKVDPNINVVLTACLTVFVGCCRSVKPTPPSETMSNEHAMRFPLVGSAMLLSLFLLFKFLSKDLVNAVLTCYFFVLGIAAFSATLLPSIKRFLPKKWNEDLIIWHFPYFRSLEVEFTRSHIVAAIPGTIFCAWYAKKKHWLANNVLGLAFSIQGIEMLSLGSFKTGAILLAGLFVYDIFWVFFTPVMVSVAKSFDAPIKLLFPTADLKRPFSMLGLGDIVIPGIFVALALRFDVSRGKEPQYFKSAFLGYAVGVVSTIVVMNWFQAAQPALLYIVPAVVGFLAVHCIWNGDVKPLLEFDESKTQSTEEVAAKESKKVE

SEQ ID NO: 5442 - protein, 339 aa, Solanum phureja
MKNMERIANVALLGLSLAPLVVNVDPNVNVIVTACLTVFVGCCRSVKPTPPSETMSNEHAMRFPLVGSAMLLSLFLLFKFLSKDLVNAVLTCYFFVLGIAALSATLLPAIKRFLPNKWNDDLIIWHFPYFRSLEIEFTRSQIVAAIPGTIFCVWYAKQKHWLANNVLGLAFCIQGIEMLSLGSFKTGAILLAGLFVYDIFWVFFTPVMVSVAKSFDAPIKLLFPTADAKRPFSMLGLGDIVIPGIFVALALRFDVSRGKEPQYFKSAFLGYTFGLALTIFVMNWFQAAQPALLYIVPAVIGFLAVHCIWNGDVKPLLEFDEGKTKDAEEAEAKESKKVE

SEQ ID NO: 5443 - protein, 339 aa, Solanum lycopersicum
MKNMERIANVALLGLSLAPLVVNVDPNVNVIVTACLTVFVGCCRSVKPTPPSETMSNEHAMRFPLVGSAMLLSLFLLFKFLSKDLVNAVLTCYFFVLGIAALSATLLPSIKRFLPKKWNDDLIIWHFPYFRSLEFEFTRSQIVSAIPGTIFCVWYAKQKHWLANNVLGLAFCIQGIEMLSLGSFKTGAILLTGLFVYDIFWVFFTPVMVSVAKSFDAPIKLLFPTADAKRPFSMLGLGDIVIPGIFVALALRFDVSRGKEPQYFKSAFLGYTFGLALTIFVMNWFQAAQPALLYIVPAVIGFLAVHCIWNGDVKPLLEFDEGKTKVAEEAEAKESKKVE

SEQ ID NO: 5444 - protein, 339 aa, Solanum lycopersicum
MKNMERIANVALLGLSLAPLVVNVDPNVNVIVTACLTVFVGCCRSVKPTPPSETMSNEHAMRFPLVGSAMLLSLFLLFKFLSKDLVNAVLTCYFFVLGVAALSATLLPSIKRFLPKKWNDDLIIWHFPYFRSLEFEFTRSQIVSAIPGTIFCVWYAKQKHWLANNVLGLAFCIQGIEMLSLGSFKTGAILLTGLFVYDIFWVFFTPVMVSVAKSFDAPIKLLFPTADAKRPFSMLGLGDIVIPGIFVALALRFDVSRGKEPQYFKSAFLGYTFGLALTIFVMNWFQAAQPALLYIVPAVIGFLAVHCIWNGDVKPLLEFDEGKTKVAEEAEAKESKKVE

SEQ ID NO: 5445 - protein, 339 aa, Capsicum annuum
MKNMESLANVALLGLSMAPLVVNVDPNVNVIVTACLTVFVGCCRSVKPTPPSETMSNEHAMRFPLVGSAMLLSLFLLFKFLSKDLVNAVLTCYFFVLGIAALSATLLPSIKRFLPKKWNDNLIIWHFPYFRSLEIEFTRSQIIAAIPGTIFCVWYARQKHWLANNVLGLAFCIQGIEMLSLGSFKTGAILLGGLFVYDIFWVFFTPVMVSVAKSFDAPIKLLFPTADAKRPFSMLGLGDIVIPGIFVALALRFDVSRGKEPQYFKSAFLGYTFGLALTIFVMNWFQAAQPALLYIVPAVIGFLSVHCIWNGDVKPLLEFDEGKTKGAEEAEAKESKKVE

SEQ ID NO: 5446 - protein, 341 aa, Prunus persica
MKNVERVANVALAGLTLAPLVVNVDPNLNVILTACLTVFVGCYRSVKPTPPSETMSNEHAMRFPFVGSAMLLSLFLLFKFLSKDLVNAVLTCYFFVLGIIALSATLLPAIARYLPQSWNKDPIIWHFPYFRSLEIEFTRSQIVAAIPGTFFCAWYASKKHWLANNILGLAFCIQGIEMLSLGSFKTGAILLAGLFVYDIFWVFFTPVMVSVAKSFDAPIKLLFPTADATRPFSMLGLGDIVIPGIFVALALRFDVSRGKQGQYFKSAFLGYTVGLVLTIVVMNWFQAAQPALLYIVPTVIGFLAAHCIWNGDVKPLLEFDESKTVETSEEGSETKSNKKVE

SEQ ID NO: 5447 - protein, 206 aa, Cicer arietinum
MKNTERIANLALAGLSLAPLVVKVDPNLNVVLTACITVFVGCYRSVKPTPPTETMSNEHAMRFPFVGSAMLLSLFLLFKFLSKDLVNTVLTGYFFVLGIVALSATLLPSIKRFLPKHWNDDLIVWRFPYFRSFEVEFTRSQIVAAVPGTFFVPGMLCRSIGWQIIYWVLLSVFRELKCFLLAHSRLVRFSWLVYLYMTFSGFSSLL

SEQ ID NO: 5448 - protein, 339 aa, Amsonia hubrichtii
MKNSERLANIALAGLTLAPLVVKVDPNLNVILTACLTVYVGCYRSVKPTPPSETMSNEHAMRFPLVGSAMLLSLFLLFKFLSKDLVNAVLTCYFFVLGIVALSATLLPAIKRFLPNHWNEDVIVWRFPFIRSLEVEFTRSQVFAAIPGTFFCAWYASKKHWLSNNILGLAFCIQGVEMLSLGSFKTGAILLAGLFVYDIFWVFFTPVMVSVAKSFDAPIKLLFPTSDSARPFSMLGLGDIVIPGIFVALALRFDVSRGKGSQYFKSAFLGYAVGLILTIIVMNWFQAAQPALLYIVPSVIGFLAVHVIWNGDIKPLLEFDESKSSDSEDGDEKSSKKVE

SEQ ID NO: 5449 - protein, 340 aa, Theobroma cacao
MKNTERLANLALAGLTLAPLAVKVDPNLNVILTACLTVYVGCYRSVKPTPPSETMSNEHAMRFPFVGSAMLLSLFLLFKFLSKDLVNAVLTCYFFVLGIIALSATILPAIKRFLPKHWNEDLIIWRFPYFRSLEIDFTRSQIVAAIPGTFFCAWYASQKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKESQYFKSAFLGYTVGLVLTIVVMNWFQAAQPALLYIVPAVIGFLAAHCIWNGEVTPLLEFDESKTGVSSQEGSDDKSSKVE

SEQ ID NO: 5450 - protein, 342 aa, Citrus sinensis
MKNCERIANLALAGLTLAPLLVKVDPNLNVILTACLTVYVGCYRSVKPTPPSETMSNEHAMRFPFVGSAMLLSLFLLFKFLSKDLVNAVLTCYFFVLGIIALSATILPAVKRFLPNHWNEDLIIWHFPYFRSLEIEFTRSQIIAAIPGTFFCAWYASQKHWLANNTLGLAFCIQGIEMLSLGSFKTGAILLAGLFVYDIFWVFFTPVMVSVAKSFDAPIKLLFPTRDTARPFSMLGLGDIVIPGIFVALALRFDVSRGKGSRYFKSAFLGYTVGLVLTIIVMNWFQAAQPALLYIVPAVIGFLAAHCIWNGEVKQLLEFDESKTAAVVSQESSDAKTSKKVE

SEQ ID NO: 5451 - protein, 341 aa, Vitis vinifera
MKNCERLANLGLAGLTLAPLVMKVDPNLNVILTACLTVYVGCYRSVKPTPPSETMSNEHAMRFPFVGSAMLLSLFLLFKFLSKDLVNAVLTCYFFVLGIIALSATLLPAIRRYLPKHWNDDPIIWHFPYFRSLEIEFTRSQIVAAIPGTFFCAWYASQKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKGNQYFKSAFLGYTTGLVVTIVVMNWFQAAQPALLYIVPAVIGFMAAHCIWNGEVKPLLEFDESKTASSSKDDGDEKSSKKVE

SEQ ID NO: 5452 - protein, 341 aa, Lotus japonicus
MKNTERLANFALLGLTLAPLVVKVDPNLNVILTACITVFVGCYRSVKPTPPTETMSNEHAMRFPFVGSAMLLSLFLLFKFLSKDLVNTVLTGYFFVLGIVALSATLLPSIKRFLPNHWNDDNIVWRFPYFRSLEVEFTRSQIVAAIPGTFFCAWYALRKHWLANNILGLAFCIQGIEMLSLGSFKTGAILLAGLFVYDIFWVFFTPVMVSVAKSFDAPIKLLFPTADAVRPFSMLGLGDIVIPGIFVALALRFDVSRGKQPQYFKSAFLGYAVGVILTIVVMNWFQAAQPALLYIVPSVIGFLAAHCVWNGEVKQLLEFDESKTANSSQEEVDAKVTKKDE

SEQ ID NO: 5453 - protein, 342 aa, Citrus sinensis
MKNCERIANLALAGLTLAPLLVKVDPNLNVILTACLTVYVGCYRSVKPTPPSETMSNEHAMRFPFVGSAMLLSLFLLFKFLSKDLVNAVLTCYFFVLGIIALSATILPAVKRFLPNHWNEDLIIWHFPYFRSLEIEFTRSQIIAAIPGTFFCAWYASQKHWLANNTLGLAFCIQGIEMLSLGSFKTGAILLAGLFVYDIFWVFFTPVMVSVAKSFDAPIKLLFPTRDTARPFSMLGLGDIVIPGIFVALALRFDVSRGKGSRYFKSAFLGYTVGLVLTIIVMNWFQAAQPALLYIVPAVIGFLAAHCIWNGEVKQLLEFDESKTAAVVSQESGDAKTSKKVE

SEQ ID NO: 5454 - protein, 341 aa, Fagus grandifolia
MKNVERIANVALAGLTLAPLVVKVDPNLNVILTAGLTVFVGCYRSVKPTPPSETMSNEHAMRFPFVGSAMLLSLFLLFKFLSKDLVNAVLTCYFFVLGIVALSATLLPAIKRYLPKHWNEDVISWHFPYFRSLDIEFTRSQIIAAIPGTFFCAWYASQKHWLANNILGLAFCIQGIEMLSLGSFKTGAILLAGLFVYDIFWVFFTPVMVSVAKSFDAPIKLLFPTADAARPYSMLGLGDIVIPGIFVALALRFDVSRGKGSQYFKSAFLGYMFGLVVTIVVMNWFQAAQPALLYIVPAVIGFLAAHCIWNGEVKPLLEFDESKTANSSEESSDDNSSKKVE

SEQ ID NO: 5455 - protein, 341 aa, Gossypium hirsutum
MKNTERLANLALAGLTLAPLVVKVDPNLNVILTACLAVYVGCYRSVKPTPPSETMSKEHAMRFPFVGSAMLLSLFLLFKFLSKDLVNAVLTCYFFVLGIIALSATILPALKHFLPKQWNEDHIIWRFPFFRSFEIEFTRSQIIAAIPGTFFCAWYASQKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKGSQYFKSAFLGYTVGLVLTIVVMNWFQAAQPALLYIVPAVIGFLAAHCIWNGDVKPLLEFDELKTAVTSEDGSDDKSSKKVE

SEQ ID NO: 5456 - protein, 339 aa, Ambrosia trifida
MKSGERAANIALAGLTLAPLVVKVDPNINVILTACLTVFVGCYRSVKPTPPTETMSNAHAMRFPLVGSAMLLSLFLLFKFLSKDLVNAVLTCYFFVLGILALSATLLPAIRRFLPTKWNEDVIHWSFPYFKSLDVEFTRSQVVAAIPGTFFCVWYVAQKHWLANNVLGLAFCIQGIEMLSLGSFTTGAILLAGLFFYDIFWVFFTPVMVSVAKSFDAPIKLLFPTGVAARPFSMLGLGDIVIPGIFVALALRFDVSRGRNNQYFKSAFLGYAVGVVLTIVVMNWFQAAQPALLYIVPAVIGFLAVHCIWNGDVKPLLEFDESKTAIDGDADENTSKKVE

SEQ ID NO: 5457 - protein, 339 aa, Cannabis sativa
MKNVERVANLALAGLTLAPLVVKVDPNLNVVLTACLTVFVGCYRSVKPTPPTETMSNEHAMRFPFVGSAMLLSLFLLFKFLSKDLVNAVLTSYFFVLGIIALSATLLPAIKRYLPKHWNEDLIVWRFPYFRSLEIEFTRSQVVAAIPGTFFCAWYASQKHWLANNILGLAFCIQGIEMLSLGSFKTGAILLAGLFVYDIFWVFFTPVMVSVAKSFDAPIKLLFPTGDSTRPFSMLGLGDIVIPGIFVALALRFDVSRGKQGQYFRSAFLGYTFGVVLTIVVMNWFQAAQPALLYIVPAVIGFLAAHVIFNGEIKPLLEFDESKASQEDEDDKVSSKKEE

SEQ ID NO: 5458 - protein, 339 aa, Gossypium raimondii
MKNAERLANLALAGLTMAPLVVKVDPNLNVVLTACLTVYVGCYRSVKPTPPSETMSNEHAMRFPFVGSAMLLSLFLLFKFLSKDLVNAVLTCYFFVLGIIALSATVLPTIKRFLPKHWNEDLIIWHFPFFRSFEIEFTRSQIIAAIPGTFFCSWYALQKHWLANNILGLAFCIQGIEMLSLGSFKTGAILLAGLFVYDIFWVFFTPVMVSVAKSFDAPIKLLFPTADSTRPFSMLGLGDIVIPGIFVALALRYDVSRGKERQYFKSAFLGYTVGLVLTIVVMNWFQAAQPALLYIVPAVIGFLAAHCIWNGEVGPLLEFDESKMAVVEGSEDKPSKKVE

SEQ ID NO: 5459 - protein, 339 aa, Gossypium hirsutum
MKNAERLANLALAGLTMAPLVVKVDPNLNVVLTACLTVYVGCYRSVKPTPPSETMSNEHAMRFPFVGSAMLLSLFLLFKFLSKDLVNAVLTCYFFVLGIIALSATILPTIKRFLPKHWNEDLIIWHFPFFRSFEIEFTRSQIIAAIPGTFFCSWYALQKHWLANNILGLAFCIQGIEMLSLGSFKTGAILLAGLFVYDIFWVFFTPVMVSVAKSFDAPIKLLFPTADSTRPFSMLGLGDIVIPGIFVALALRYDVSRGKERQYFKSAFLGYTVGLVLTIVVMNWFQAAQPALLYIVPAVIGFLAAHCIWNGEVGPLLEFDESKMAVVEGSEDKPSKKVE

SEQ ID NO: 5460 - protein, 268 aa, Catharanthus roseus
MKNNERLANIALAGLSLAPLFVKVDPNLNVILTACLTVYVGCYRSVKPTPPSETMSNEHAMRFPLVGSAMLLSLFLLFKFLSKDLVNAVLTCYFFVLGIVALSATLLPAIKRFLPKHWNEDAIVWRFPFIRSLEVEFTRSQVVAAIPGFFFCAWYASKKHWLSNNILGLAFCIQGIEMLSLGSFKTGAILLAGLFVYDIFWVFFTPVMVSVAKSFDAPIKLLFPTADSARPFSMLGLGDIVIPGIFVALALRFDVSRGKGANTSRVLF

SEQ ID NO: 5461 - protein, 341 aa, Ambrosia trifida
MKSGERAANIALAGLTLAPLVVKVDPNINVILTACLTVFVGCYRSVKPTPPTETMSNAHAMRFPLVGSAMLLSLFLLFKFLSKDLVNAVLTCYFFVLGILALSATLLPAIRRFLPNKWNEDVIHWSFPYFKSLDVEFTRSQVVAAIPGTFFCVWYVAQKHWLANNVLGLAFCIQGIEMLSLGSFTTGAILLAGLFFYDIFWVFFTPVMVSVAKSFDAPIKLLFPTGVTARPFSMLGLGDIVIPGIFVALALRFDVSRGRNNQYFKSAFLGYAVGVVLTIVVMNWFQAAQPALLYIVPAVIGFLAVHCIWNGDVKPLMEFDESKTAISSDGDADENTSKKVE

SEQ ID NO: 5462 - protein, 341 aa, Unknown
  Sequence found in Organisms: Gossypium hirsutum, Gossypium raimondii
MKNTERLANLALAGLTLAPLVVKVDPNLNVILTACLAVYVGCYRSVKPTPPSETMSKEHAMRFPFVGSAMLLSLFLLFKFLSKDLVNAVLTCYFFVLGIIALSATILPALKHFLPKHWNEDHIIWRFPFFRSFEIEFTRSQIIAAIPGTFFCAWYASQKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKGSQYFKSAFLGYTVGLVLTIVVMNWFQAAQPALLYIVPAVIGFLAAHCVWNGDVKPLLEFDELKTAVTSEDGSDDKSSKKVE

SEQ ID NO: 5463 - protein, 341 aa, Ricinus communis
MKNGERLANIALAGLTLAPLVVKVDPNLNVILTACLAVYVGCYRSVKPTPPAETMSNEHAMRFPFVGSAMLLSLFLLFKFLSKDLVNAVLTCYFFVLGIIALSATLLPAIKRYLPKHWNDDVITWHFPYFRSLEIEFTRSQVVASIPGTFFCAWYASQKHWLANNILGLAFCIQGIEMLSLGSFKTGAILLAGLFVYDIFWVFFTPVMVSVAKSFDAPIKLLFPTADAARPFSMLGLGDIVIPGIFVALALRFDVSRGKDSQYFKSAFLGYTAGVVLTIVVMNWFQAAQPALLYIVPAVIGFLAAHVIWNGEVKPLMEFDESKTAASTQESSESNSAKKVE

SEQ ID NO: 5464 - protein, 341 aa, Trigonella foenum-graecum
MKNTERIANLALLGLTLAPLVVKVDPNLNVVLTACITVFVGCYRSVKPTAPTETMSKEHAMRFPFVGSAMLLSLFLLFKFLSKDLVNTVLTGYFFVLGIVALSATLLPSIKRFLPKHWNDELIVWRFPYFRSVEIEFTRSQIVAAVPGTFFCAWYALRKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGRKPQYFKSAFLGYTFGVVLTIVVMNWFQAAQPALLYIVPAVIGFLAAHCIWNGDVKQLLEFDESKTANSSQEESDAKSSKKVE

SEQ ID NO: 5465 - protein, 293 aa, Platanus occidentalis
MSKEHAMRFPLVGSAMLLSLFLLFKFLSKDLVNAVLTCYFFVLGIVALAATLLPAIRRFLPRNWNEKLIVWHLPYFRSVEVEFTMSQIIAAIPGTFFCAWYAKQKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKENRYFRSAFFGYTVGLVLTIIVMNWFQAAQPALLYIVPAVIGFLAVHCIWNGEVKPLLEFDESKTAAASSTQDGDSSSGDAKSSKKVE

SEQ ID NO: 5466 - protein, 339 aa, Gossypium hirsutum
MKNAERLANLALAGLTMAPLVVKVDPNLNVVLTACLTVYVGCYRSVKPTPPLETMSNEHAMRFPFVGSAMLLSLFLLFKFLSKDLVNAVLTCYFFVLGIIALSATVLPTIKRFLPKHWNEDLIIWHFPFFLSFEIEFTRSQIIAAIPGTFFCSWYALQKHWLANNILGLAFCIQGIEMLSLGSFKTGAILLAGLFVYDIFWVFFTPVMVSVAKSFDAPIKLLFPTADSTRPFSMLGLGDIVIPGIFVALALRYDVSRGKERQYFKSAFLGYTVGLVLTIVVMNWFQAAQPALLYIVPAVIGFLAAHCIWNGEVGPLLEFDESKMAVVEGSEDKPSKKVE

SEQ ID NO: 5467 - protein, 341 aa, Gossypium hirsutum
MKNTERLANLALAGLTLAPLVVKVDPNLNVILTACLAVYVGCYRSVKPTPPSETMSKEHAMRFPFVGSAMLLSLFLLFKFLSKDLVNAVLTCYFFVLGIIALSATILPALKHFLPKHWNEDHIIWRFPFFRSFEIEFTRSQIIAAIPGTFFCAWYASQKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKGSQYFKSAFLGYTVGLVLTIVVMNWFQAAQPALLYIVPAVIGFLAAHCVWNGDVKPLLEFDELKTAVTSSDGSDDKSSKKVE

SEQ ID NO: 5468 - protein, 341 aa, Flaveria ramosissima
MKSGERAANIALAGLTLAPLVVKVDPNINVILTACLTVFVGCYRSVKPTPPSETMSNAHAMRFPLVGSAMLLSLFLLFKFLSKDLVNAVLTCYFFVLGILALSATLLPAIRRFLPTKWNEDVIHWSFPYFKSLDVEFTRSQVVAAIPGTFFCVWYVAQKHWLANNILGLAFCIQGIEMLSLGSFKTGAILLAGLFFYDIFWVFFTPVMVSVAKSFDAPIKLLFPTGVAARPFSMLGLGDIVIPGIFVALALRFDVSRGRNNQYFKSAFLGYAVGVVFTIVVMNWFQAAQPALLYIVPAVIGFLAAHCVWNGDVKPLLEFDESKTAISSDGDAGENTSKKVE

SEQ ID NO: 5469 - protein, 341 aa, Gossypium raimondii
MKNCERLANLALAGLTLAPLVVKVDPNLNVILTACLAVYVGCYRSVKPTPPLETMSKEHAMRFPFIGSAMLLSLFLLFKFLSKDLVNAVLTCYFFVLGTVALSATILPAMKRFLPKHWNEDLIIWRFPYFRSLEIEFTRSQIIAAIPGSFFCAWYASQKHWLANNILGLAFCIQGIEMLSLGSFKTGAILLTGLFVYDIFWVFFTPVMVSVAKSFDAPIKLLFPTADSARPFSMLGLGDIVIPGIFVALALRFDASRGKGSQYFKSAFSGYTVGLVLTIIVMNWFQAAQPALLYIVPAVMGFLALHCIWNREVKPLLEFDESNTEIKSQEGSTDEYSKKVE

SEQ ID NO: 5470 - protein, 341 aa, Helianthus annuus
MKSGERAANIALAGLTLAPLVMKVDPNINVILTACLTVFVGCYRSVKPTPPTETMSNAHAMRFPLVGSAMLLSLFLLFKFLSKDLVNAVLTCYFFVLGILALSATLLPAIRRFLPTKWNEDVIHWSFPYFKSLDVEFTRSQVVAAIPGTFFCVWYVAQKHWLANNVLGLAFCIQGIEMLSLGSFTTGAILLAGLFFYDIFWVFFTPVMVSVAKSFDAPIKLLFPTGVTARPFSMLGLGDIVIPGIFVALALRFDVSRGRTNQYFKSAFLGYAVGVVLTIVVMNWFQAAQPALLYIVPAVIGFLAAHCIWNGEVKPLLEFDESKTASSSDGDADENTSKKVE

SEQ ID NO: 5471 - protein, 341 aa, Valeriana officinalis
MKNGERLANIALAGLTLAPLVVKVDPNLNVILTACLSVYVGCYRSVKSTPPTETMSNEHAMRFPLVGSAMLLSLFLLFKFLSKDLVNAVLTSYFVVLGIVALSATLLPAIRRFLPNKWNDELIVWHLPYYRSVEIEFTRSQVVASIPGTFFCAWYVSQKHWLANNILGLAFCIQGIEMLSLGSFKTGAILLAGLFVYDIFWVFFTPVMVSVAKSFDAPIKLLFPTADAARPFSMLGLGDIVIPGIFVALALRFDVSRGKQCQYFKSAFLGYAVGVILTIIVMNWFQAAQPALLYIVPCVIGFLAVHCFWNGEVKPLLEFDESKTATASEDDKESASSKKDE

SEQ ID NO: 5472 - protein, 341 aa, Malus domestica
MKNVERIANIALAGLTLAPLVVKVDPNLNVVLTACLTVFVGCYRSVKPTPPSETMSNEHAMRFPFVGSAMLLSLFLLFKFLSKDLVNAVLTCYFFVLGIIALSATLLPAIARYLPESWNKDPIVWRFPYFRSLEIEFTKSQIVSAIPGTFFCAWYASKKHWLANNILGLAFCIQGIEMLSLGSFKTGAILLAGLFVYDIFWVFFTPVMVSVAKSFDAPIKLLFPTADAARPFSMLGLGDIVIPGIFVALALRFDVSRGGKGQYFKSAFLGYTVGLVLTIVVMNWFQAAQPALLYIVPSVIGFLAAHCIWNGDVKPLLAFDESKSAVISEEESDPKTIKKVE

SEQ ID NO: 5473 - protein, 341 aa, Populus trichocarpa
MKNCERVANLALAGLTLAPLFVKVDPNLNVILTACLTVYVGCYRSVKPTPPSETMSNEHAMRFPFVGSAMLLSLFLLFKFLSKDLVNAVLTCYFFVLGIVALSATLLPAIKRYLPKHWNDDVISWHFPYFRSLEIEFTRSQIVAAIPGTFFCAWYASQKHWLANNILGLAFCIQGIEMLSLGSFKTGAILLAGLFVYDIFWVFFTPVMVSVAKSFDAPIKLLFPTADTARPFSMLGLGDIVIPGIFVALALRFDVSRGKESQYFKSAFLGYTAGVVLTIIVMNWFQAAQPALLYIVPAAIGFLAAHVVWNGEVKPLMEFDESKTAASSQEDSETSSSKKVE

SEQ ID NO: 5474 - protein, 341 aa, Fragaria vesca
MKNVERFANIALAGLTLAPLVVKVDPNLNVVLTACLTVFVGCYRSVKPTPPTETMSNEHAMRFPFVGSAMLLSLFLLFKFLSKDLVNAVLTCYFFVLGIIALSATLLPAIARYLPERWNKDLIVWHLPYFRSVEIEFTRSQIFAAIPGFFFCAWYASKKHWLANNILGLAFCIQGIEMLSLGSFKTGAILLAGLFVYDIFWVFFTPVMVSVAKSFDAPIKLLFPTADIARPFSMLGLGDIVIPGIFVALALRFDVSRGKEGQYFKSAFLGYTMGLVLTIVVMNWFQAAQPALLYIVPAVIGFLATHCIWNGDVKPLLAFDESKTTTKSEADNDDKLNKKVE

SEQ ID NO: 5475 - protein, 287 aa, Ambrosia trifida
MSNAHAMRFPLVGSAMLLSLFLLFKFLSKDLVNAVLTCYFFVLGILALSATLLPAIRRFLPTKWNDDVIHWSFPYFKSLDVEFTRSQVVAAIPGTFFCVWYVAQKHWLANNVLGLAFCIQGIEMLSLGSFTTGAILLAGLFFYDIFWVFFTPVMVSVAKSFDAPIKLLFPTGVTARPFSMLGLGDIVIPGIFVALALRFDVSRGRNNQYFKSAFLGYAVGVVLTIVVMNWFQAAQPALLYIVPAVIGFLAVHCIWNGDVKPLMEFDESKTAISSDGDADENTSKKVE

SEQ ID NO: 5476 - protein, 287 aa, Ambrosia trifida
MSNAHAMRFPLVGSAMLLSLFLLFKFLSKDLVNAVLTCYFFVLGILALSATLLPAIRRFLPNKWNEDVIHWSFPYFKSLDVEFTRSQVVAAIPGTFFCVWYVAQKHWLANNVLGLAFCIQGIEMLSLGSFTTGAILLAGLFFYDIFWVFFTPVMVSVAKSFDAPIKLLFPTGVTARPFSMLGLGDIVIPGIFVALALRFDVSRGRNNQYFKSAFLGYAVGVVLTIVVMNWFQAAQPALLYIVPAVIGFLAVHCIWNGDVKPLLEFDESKTAIGSDGDADENTSKKVE

SEQ ID NO: 5477 - protein, 340 aa, Eucalyptus grandis
MKNCERIANVALAGLTLAPLVVKVNPNLNVILTACLTVYVGCYRSVKPTPPSETMSNEHAMRFPFVGSAMLLSLFLLFKFLSKDLVNAVLTSYFFVLGIVALSATLLPAIKRYLPDHWNEDVITWRFPYFRSLEIEFTRSQIVAAIPGTFFCAWYASKKHWLANNILGLAFCIQGIEMLSLGSFKTGAILLAGLFVYDIFWVFFTPVMVSVAKSFDAPIKLLFPTADATRPFSMLGLGDIVIPGIFVALALRFDVSRGKESQYFKSAFFGYISGVVLTIIVMNWFQAAQPALLYIVPAVIGSLAAHCLWNGDVKQLLEFDESKTSASSQEDVDAKSGKAE

SEQ ID NO: 5478 - protein, 341 aa, Flaveria ramosissima
MKSGERAANIALAGLTLAPLVVKVDPNINVILTACLTVFVGCYRSVKPTPPSETMSNAHAMRFPLVGSAMLLSLFLLFKFLSKDLVNAVLTCYFFVLGILALSATLLPAIRRFLPTKWNEDVIHWSFPYFKSLDVEFTRSQVVAAIPGTFFCVWYVAQKHWLANNILGLAFCIQGIEMLSLGSFKTGAILLAGLFFYDIFWVFFTPVMVSVAKSFDAPIKLLFPTGVAARPFSMLGLGDIVIPGIFVALALRFDVSRGRNNQYFKSAFLGYAVGVVLTIVVMNWFQAAQPALLYIVPAVIGFLAAHCIWNGEVKPLLEFDESKTAISGDADADENTSKKVE

SEQ ID NO: 5479 - protein, 341 aa, Helianthus annuus
MKSGERAANIALAGLTLAPLVMKVDPNINVILTACLTVFVGCYRSVKPTPPTETMSNAHAMRFPLVGSAMLLSLFLLFKFLSKDLVNAVLTCYFFVLGILALSATLLPAIRRFLPTKWNEDVIHWSFPYFKSLDVEFTRSQVVAAIPGTFFCVWYVAQKHWLANNVLGLAFCIQGIEMLSLGSFTTGAILLAGLFFYDIFWVFFTPVMVSVAKSFDAPIKLLFPTGVTARPFSMLGLGDIVIPGIFVALALRFDVSRGRNNQYFTSAFLGYAVGVVLTIVVMNWFQAAQPALLYIVPAVIGFLAAHCIWNGEVKPLLEFDESKTAVSSDGDADENTSKKVE

SEQ ID NO: 5480 - protein, 341 aa, Manihot esculenta
MKNNERLANFALAGLTLAPLLVKVDPNLNVILTACLAVYVGCYRSVKPTPPSETMSNEHAMRFPFVGSAMLLSLFLLFKFLSKDLVNAVLTCYFFVLGIIALSATLLPAIKRYLPKHWNDDLITWHFPYFRSLEIEFTRSQIVAAIPGTFFCAWYASQKHWLANNILGLAFCIQGIEMLSLGSFKTGVILLAGLFVYDIFWVFFTPVMVSVAKSFDAPIKLLFPTADAKRPFSMLGLGDIVIPGIFVALALRFDVSRGKDSQYFKSAFLGYTVGLVLTIVVMNWFQAAQPALLYIVPAVIGFLAAHVIWNGEVQPLLEFNESKSASSSQDSSEIDSAKKVE

SEQ ID NO: 5481 - protein, 341 aa, Gossypium hirsutum
MKNCERLANLALAGLTLAPLVVKVDPNLNVILTACLAVYVGCYRSVKPTPPLETMSKEHAMRFPFIGSAMLLSLFLLFKFLSKDLVNAVLTCYFFVLGTVALSATILPAMKRFLPKHWNEDLIIWRFPYFRSLEIEFTRSQIIAAIPGSFFCAWYASQKHWLANNILGLAFCIQGIEMLSLGSFKTGAILLTGLFVYDILWVFFTPVMVSVAKSFDAPIKLLFPTADSARPFSMLGLGDIVIPGIFVALALRFDASRGKGSQYFKSAFSGYTVGLVLTIIVMNWFQAAQPALLYIVPAVMGFLALHCIWNREVKPLLEFDESNTEIKSQEGSTDEYSKKVE

SEQ ID NO: 5482 - protein, 341 aa, Gossypium hirsutum
MKNCERLANLALAGLTLAPLVVKVDPNLNVILTACLAVYVGCYRSVKPTPPSETMSKEHAMRFPFIGSAMLLSLFLLFKFLSKDLVNAVLTCYFFVLGTVALSATILPAMKRFLPKHWNEDLIIWRFPYFRSLEIEFTRSQIIAAIPGSFFCAWYASQKHWLANNILGLAFCIQGIEMLSLGSFKIGAILLTGLFVYDIFWVFFTPVMVSVAKSFDAPIKLLFPTTDSARPFSMLGLGDIVIPGIFVALALRFDASRGKGSQYFKSAFSGYTVGLVLTIIVMNWFQAAQPALLYIVPAVMGFLALHCIWNGEVKPLLEFDESNTEVKSQEGSTDEYSKKVE

SEQ ID NO: 5483 - protein, 341 aa, Cucumis sativus
MKNAERIANFALAGLTLAPLVMKVDPNVNVVLTACLTVYVGCYRSVKPTPPSETMSSEHAMRFPFVGSAMLLSLFLLFKFLSKDLVNAVLTCYFFVLGILALSATLLPAIKRYLPDHWNEDAISWRFPYFRSLEIEFTRSQVVAAIPGTFFCAWYALKKHWLANNILGLAFCIQGIEMLSLGSFKTGAILLAGLFVYDIFWVFFTPVMVSVAKSFDAPIKLLFPTADAARPFSMLGLGDIVIPGIFVALALRFDASRGKDGQYFKSAFLGYSVGLVLTIIVMNWFQAAQPALLYIVPAVIGFLAAHVIWNGDVKPLLEFDESKTGIASEDGGEDDKGSKKE

SEQ ID NO: 5484 - protein, 341 aa, Glycine max
MKNTERIANLALAGLTLAPLVVKVDPNLNVILTASLTVFVGCYRSVKPTPPTETMSNEHAMRFPFVGSAMLLSLFLLFKFLSKDLVNTVLTGYFFVLGIVALSATLLPFIKRFLPKHWNEDLIVWRFPYFRSLEIEFTKSQVVAGIPGTFFCAWYALQKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKQPQYFKSAFVGYTVGLVLTIVVMNWFQAAQPALLYIVPSVIGFLAAHCLWNGDVKQLLEFDESKTANSPQESADDKSSKKVE

SEQ ID NO: 5485 - protein, 206 aa, Cicer arietinum
MKNTERIANLALAGLTLAPLVVKIDPNVNVILTACVTVFVGCYRSVKPTPPAETMSNEHAMRFPFVGSAMLLSLFLLFKFLSKDLVNTVLTLYFFVLGIVALSATLLPSIKRFLPKHWNEDLIVWHFPYFRSLEIEFTKSQIVAAIPGTFFVDGMLYRSIGWQITSWVLLSVYRELKCSLLGLSRLVLFCWLGSFFTTFSGFSSRQ

SEQ ID NO: 5486 - protein, 338 aa, Cirsium arvense
MKNGERAANIALAGLTLAPLFVKVDTNINVVLTACLTVFVGCYRSVKPTPPTETMSNEHAMRFPLVGSAMLLSLFLLFKFLSKDLVNAVLTCYFFILGIIALSATLLPAIGRFLPKKWNEDVIIWRFPYFRSLEVEFTRSQVVAAIPGTFFCAWYAAQKHWLANNILGLAFCIQGIEMLSLGSFKTGAILLSGLFVYDIFWVFFTPVMVSVAKSFDAPIKLLFPSRIETRPFSMLGLGDIVIPGIFVALALRFDVSRGKESHYFKSAFMGYTAGLVLTIVVMNWFQAAQPALLYIVPGVIGFLAVHCLWNGEVKPLLEFDESKTAVAEEETSSSKKLE

SEQ ID NO: 5487 - protein, 339 aa, Phaseolus vulgaris
MKKTERIANLALTGLTLAPLVVKVDPNLNVILTACLTVFVGCYRSVKPTPPTETMSNEHAMRFPFVGSAMLLSLFLLFKFLSKDLVNTVLTGYFFVLGIVALSATILPFIKRFLPKNWNEDTIVWRFPYFRSLEIEFTRSQVVAGIPGTFFCAWYALRKHWLANNILGLAFCIQGIEMLSLGSFKTGAILLAGLFVYDIFWVFFTPVMVSVAKSFDAPIKLLFPTADSVRPFSMLGLGDIVIPGIFVALALRFDVSRGKQPQYFKSAFVGYTVGLVLTIIVMNWFQAAQPALLYIVPSVIGFLAAHCIWNGDVKQLLEFDESKAANSPEEDDKSSKKVE

SEQ ID NO: 5488 - protein, 340 aa, Taraxacum officinale
MKNAERAANIALAGLTLAPLVVKVDPNVNVILTACLTVFVGCYRSVKPTPPSETMSNEHAMRFPLVGSAMLLSLFLLFKFLSKDLVNAVLTCYFFVLGIIALSATLLPAIRRFLPTKWNEDVITWQFPYFRSLDVEFTRSQVIAGIPGTFFCVWYVAQKHWLANNILGLAFCIQGIEMLSLGSFKTGAILLAGLFFYDIFWVFFTPVMVSVAKSFDAPIKLLFPTRDAVRPFSMLGLGDIVIPGIFVALALRFDVSRGQKSQYFKSAFLGYAVGVVLTIVVMNWFQAAQPALLYIVPSVIGFLGAHCIWNGEVKPLLEFDESKTVDGDGEVDEKNSKKIE

SEQ ID NO: 5489 - protein, 206 aa, Tropaeolum majus
MKNYERIANFALAGLSLAPLVVNVNPNLNVILTACLTVFVGCYRSVKPTPPSETMSNEHAMRFPFVGSAMLLSLFLLFKFLSKDLVNAVLTSYFFVLGIIAFSATLLPSIKDSCQIIGTMRLSYGASLISVLWRSSSQGLSLLQQSQGPFSVHGMLGRSIGWLITFWALLSVFRELKCFHLVLLKLVPFFWVDFLCMIFSGFFSLL

SEQ ID NO: 5490 - protein, 341 aa, Medicago truncatula
MKNTERIANLALLGLTLAPLVLKVDPNLNVVLTACITVFVGCYRSVKPTAPTETMSKEHAMRFPFVGSAMLLSLFLLFKFLSKDLVNTVLTGYFFVLGIVALSATLLPSIKRFLPNHWNDDLIVWRFPYFRSVEIEFTRSQIVAAVPGTFFCAWYALRKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGRKPQYFKSAFLGYTFGLVLTIVVMNWFQAAQPALLYIVPAVIGFLAAHCIWNGEVKQLLEFDESKTADSSQEESDAKSSKKDE

SEQ ID NO: 5491 - protein, 341 aa, Cucumis melo
MKNAERIANFALAGLTLAPLVMKVDPNVNVVLTACLTVYVGCYRSVKPTPPSETMSSEHAMRFPFVGSAMLLSLFLLFKFLSKDLVNAVLTCYFFVLGILALSATLLPAIKRYLPDHWNEDAIVWRFPYFRALEIEFTRSQVVAAIPGTFFCAWYALKKHWLANNILGLAFCIQGIEMLSLGSFKTGAILLAGLFVYDIFWVFFTPVMVSVAKSFDAPIKLLFPTADAARPFSMLGLGDIVIPGIFVALALRFDASRGKDGQYFKSAFLGYSVGLVLTIIVMNWFQAAQPALLYIVPAVIGFLAAHVIWNGDVKPLLEFDESKTGIASEGGGEDDKGSKKE

SEQ ID NO: 5492 - protein, 341 aa, Populus trichocarpa
MKNCERIANFALAGLTLAPLFVKVDPNLNVILTACLAVYVGCYRSVKPTPPSETMSNEHAMRFPFVGSAMLLSLFLLFKFLSKDLVNAVLTCYFFVLGIVALSATLLPAIKRYLPKHWNDDVISWNFPYFRSLDIEFTRSQIVAAIPGTFFCAWYASQKHWLANNILGLAFCIQGIEMLSLGSFKTGAILLAGLFVYDIFWVFFTPVMVSVAKSFDAPIKLLFPTADAARPFSMLGLGDIVIPGIFVALALRFDVSRGKDSQYFKSAFLGYAAGLVLTIIVMNWFQAAQPALLYIVPAVIGFLAAHVLWNGEVKPLMEFDESKTAVSSQEDSGTSSSKKVE

SEQ ID NO: 5493 - protein, 341 aa, Glycine max
MKNTERIANLAVAGLTLAPLIVKVDSNVNVILTACLTVYVGCYRSVKPTPPTETMSNEHAMRFPFVGSAMLLSLFLLFKFLSKDLVNAVLTGYFFLLGIVALSATLLSSVKRFLPKHWNEDPIVWRFPYFRSLEIEFTKSQIVAAIPGTFFCAWYALRKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKQPQYFKSAFLGYTVGLVLTIIVMNWFQAAQPALLYIVPSVIGFLAAHCIWNGDVKQLLEFDESKTAKSSQEEGDAKSSKKVE

SEQ ID NO: 5494 - protein, 356 aa, Trigonella foenum-graecum
MKNIERIANLALAGLTLAPLVVKIDPNVNVILTACITVFVGCYRSVKPTPPTETMSNEHAMRFPFVGSAMLLSLFLLFKFLSKDLVNTVLTLYFFVLGIVALSATLLPSIKRFLPKPWNDDLIVWRFPYFRSLEIEFTKSQIIAAIPGTFFCGWYALQKHWLANNILGLAFCIQGIEMLSLGSFKTGAILLVGLFFYDIFWVFFTPVMVSVAKSFDAPIKLLFPTADAKRPFSMLGLGDIVIPGIFVALALRFDVSRGRQPQYFKSAFLGYTVGLALTIVVMNWFKAAQPALLYIVPAVIGFLAVHCIWNGDVKQLLEFDESKTAKSSEEESDGKSSEKVESTGEESDAKSSKKDE

SEQ ID NO: 5495 - protein, 339 aa, Cirsium arvense
MKSGERAANIALAGLTLAPLVLKVDPNINVILTACLTVFVGCYRSVKPTPPSETMSNEHAMRFPLVGSAMLLSLFLLFKFLSKDLVNAVLTAYFFVLGILALSATLLPAITRFLPTKWNEDVITWHFPRFRSLDVEFTRSQVVAAIPGTFFCVWYVAQKHWLANNILGLAFCIQGIEMLSLGSFKTGAILLTGLFVYDIFWVFFTPVMVSVAKSFDAPIKLLFPTRDAVRPFSMLGLGDIVIPGIFVALALRFDVSRGRTSHYFKSAFLGYAVGVILTIIVMNWFQAAQPALLYIVPAVIGFLAAHCIWNGEVKPLLEFDESKSAIADTDVDEKTSKIE

SEQ ID NO: 5496 - protein, 339 aa, Orobanche aegyptiaca
MKNNERLANLALAGLSLAPLVVKVDPNLNVILTACLTVYVGCYRSVKPTPPSETMSNEHAMRFPFVGSAMLMSLFLLFKFVSKDLVNAVLTCYFFVLGIAALSATLLPAIKRFLPIPWNDNLIIWRFPYFRSLEVEFTKSQIVAAIPGTFFCVWYALQKHWLANNILGLAFCIQGIEMLSLGSFKTGAILLSGLFVYDIFWVFFTPVMVSVAKSFDAPIKLLFPTANAARPFSMLGLGDIVIPGIFVALALRFDVARGKESQYFKSAFVGYTVGLAATIVVMNWFKAAQPALLYIVPGVIGFLAAHCIWNGEVKSLLAFNESKTSSSEETDADSNTKAD

SEQ ID NO: 5497 - protein, 340 aa, Lippia dulcis
MKNNERLANLALAGLTLAPLVVKVDPNLNVILTACLTVYVGCHRSVKPTPPSETMSNEHAMRFPLVGSAMLLSLFLLFKFLSKDLVNAVLTCYFFVLGIFALSATLLPAIKRFLPDTWNDNLIIWRFPYFRSLEVEFTKSQIIASIPGTFFCVWYASKKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKESHYFKSAFVGYTAGLVATIIVMNWFQAAQPALLYIVPGVIGFLAAHCLWNGEVKPLLAFDEAKTSSSEATEAADSNKKAD

SEQ ID NO: 5498 - protein, 337 aa, Primula obconica
MKNCERAANIALAGLALAPLVIKVDPNLNVVLTACLTVYVGCYRSVKPTPPSETMSNEHAMRFPLVGSAMLLSLFLLFKFLSKDLVNAVLTSYFFVLGIVALSATVLPSIQRFLPKKWNEDVISWHFPYFRYLEVEFTRSQVVAAIPGTFFCAWYASQKHWLANNTLGLAFCIQGIEMLSLGSFKTGCILLSGLFVYDIFWVFFTPVMVSVAKSFDAPIKLLFPTGDSSRPFSMLGLGDIVIPGIFVALALRFDVSRGKGSQYFKSAFLGYTAGLVLTIVVMNWFQAAQPALLYIVPAVIGSLATHCIWNGDVKQLLEFDESKTASEDDDKSSKKDE

SEQ ID NO: 5499 - protein, 362 aa, Vinca minor
MKNHERLANIALAGLSLAPLFVKVDPNVNVILTACLTVYVGCYRSVKSTPPSETMSNEHAMRFPLVGSAMLLSLFLLFKFLSKDLVNAVLTCYFFVLGIVALSATLLPAIKRFLPKHWNEDVITWRFPIIRSLEVEFTRSQVVAAIPGTFFCAWYAAKKHWLSNNILGLAFCIQGVEMLSLGSFKTGGILLAGLFVYDIFWVFFTPVMVSVAKSFDAPIKLLFPTADSSRPFSMLGLGDIVIPGIFVALALRFDVSRGKGIQYFKSAFLGYAFGLILTIIVMNWFQAAQPALLYIVPSVIGFLAVHVIWNGDIKPFLEFDESKSSDSQDGDEKSTKNEDEKSKNDDEKSTENGGETSDKKVD

SEQ ID NO: 5500 - protein, 341 aa, Flaveria ramosissima
MKSGERAANIALAGLTLAPLVVKVDPNINVILTACLTVFVGCYRSVKPTPPSETMSNAHAMRFPLVGSAMLLSLFLLFKFLSKDLVNAVLTCYFFVLGILALSATLLPAIRRFLPTKWNEDVIHWSFPYFKSLDVEFTRSQVVAAVPGYLFCVWYVAQKHWLANNILGLAFCIQGIEMLSLGSFKTGAILLAGLFFYDIFWVFFTPVMVSVAKSFDAPIKLLFPTGVAARPFSMLGLGDIVIPGIFVALALRFDVSRGRNNQYFKSAFLGYAVGVVLTIVVMNWFQAAQPALLYIVPAVIGFLAAHCIWNGEVKPLLEFDESKTAINSDGDADENTSKKVE

SEQ ID NO: 5501 - protein, 132 aa, Flaveria ramosissima
MKSGERAANIALAGLTLAPLVLKVDPNINVILTACLTVFVGCYRSVKPTPPSETMSNAHAMRFPLVGSAMLLSLFLLFKFLSKDLVNAVLTCYFFVLGILALSATLLPAIRRFYLPSGMKMLFIGVSHILNL

SEQ ID NO: 5502 - protein, 339 aa, Lactuca sativa
MKNAERAANIALAGLTLAPLVVKVDTNLNVVLTACLTVFVGCYRSVKPTPPSETMSNEHAMRFPLVGSAMLLSLFLLFKFLSKDLVNAVLTGYFFILGIIALSATLLPAIDRFLPNKWNDDVIIWRLPYFRSLDVTFEFTRSQVVAAIPGTFFCAWYAAQKHWLANNILGLAFCIQGIEMLSLGSFKTGAILLAGLFVYDIFWVFFTPVMVSVAKSFDAPIKLLFPSRIAARPFSMLGLGDIVIPGIFVALALRFDVSRGRESHYFKSAFLGYTVGLVLTIVVMNWFQAAQPALLYIVPGVIGFLAAHCLWNGEVKPLLEFDESKTAGEEEAISSKKVE

SEQ ID NO: 5503 - protein, 341 aa, Citrullus lanatus
MKNAERIANFALAGLTLAPLVMKVDPNVNVVLTACLTVYVGCYRSVKPTPPSETMSSEHAMRFPFVGSAMLLSLFLLFKFLSKDLVNAVLTCYFFVLGILALSATLLPAIKRFLPDHWNQDAIVWRFPYFRALEIEFTRSQVVAAIPGTFFCAWYALKKHWLANNILGLAFCIQGIEMLSLGSFKTGAILLAGLFVYDIFWVFFTPVMVSVAKSFDAPIKLLFPTADAARPFSMLGLGDIVIPGIFVALALRFDASRGKDGQYFNSAFVGYTVGLVLTIIVMNWFQAAQPALLYIVPAVIGFLAAHVIWNGDVKPLLEFDESKMGISSEDGGEDDKGSKKE

SEQ ID NO: 5504 - protein, 341 aa, Glycine max
MKNTERIANLALAGLTLAPLVVKVDPNLNVILTACLTVFVGCYRSVKPTPPTETMSNEHAMRFPFVGSAMLLSLFLLFKFLSKDLVNTVLTGYFFVLGIVALSATLLPFIKRFLPKHWNDDVIVWHFPYFRSLEIEFTKSQVVAGIPGTFFCAWYALRKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKQPQYFKSAFVGYTVGLVLTIVVMNWFQAAQPALLYIVPSVIGFLAAHCLWNGDVKQLLEFDESKTANSPQESDDDKSSKKVE

SEQ ID NO: 5505 - protein, 338 aa, Cirsium arvense
MKNGERAANIALAGLTLAPLFVKVDTNINVVLTACLTVFVGCYRSVKPTPPSETMSNEHAMRFPLVGSAMLLSLFLLFKFLSKDLVNAVLTCYFFILGIIALSATLLPAIGRFLPKKWNDNVIIWRFPYFRSLEFEFTRSQVVAAIPGTFFCAWYAAQKHWLANNILGLAFCIQGIEMLSLGSFKTGAILLAGLFVYDIFWVFFTPVMVSVAKSFDAPIKLLFPSRIDTRPFSMLGLGDIVIPGIFVALALRFDVSRGKESHYFKSAFLGYTAGLVVTIVVMNWFQAAQPALLYIVPGVIGFLAVHCLWNGEVKPLLEFDESKTAAVGEETSSSKKLE

SEQ ID NO: 5506 - protein, 340 aa, Cajanus cajan
MKKTERIANLALAGLTLAPLVVKVDPNVNVILTASITVFVGCYRSVKPTPPTETMSNEHAMRFPFVGSAMLLSLFLLFKFLSKDLVNTVLTAYFFVLGIVALSATLLPFIRRFLPKHWNEDVIVWRFPFFRSLEIEFTRSQIVAGIPGTFFCAWYASHKHWLANNILGLAFCIQGIEMLSLGSFKTGAILLAGLFVYDIFWVFFTPVMVSVAKSFDAPIKLLFPTSDSARPFSMLGLGDIVIPGIFVALALRYDVSRGKQPQYFKSAFLGYTFGLVLTIIVMNWFQAAQPALLYIVPSVIGFLAAHCIWNGDVKQLLEFDESKTANSSEESDAKSSKKVE

SEQ ID NO: 5507 - protein, 352 aa, Cephalotaxus harringtonia
MKTTEKLANLALAGLSLAPLVVKVNPNLNVVLTACLTVYIGCHRSVKPAPPSETMSKEHAMRFPLIGSVVLVSLFLLFKFLSKDLVNAILTCYFFVLGIIAFSATLLPAIDRFLPREWNETTINWHLPYFKSVEVEFTKSQVVAAIPGTFFCTWYALKKHWLANNILGLAFCIQGIEMLSLGSFKTGAILLAGLFVYDIFWVFFTPVMVSVAKSFDAPIKLLFPTADLARPYSMLGLGDIVIPGIFVALALRFDVSRGKGERYFRSAFFGYSVGVIVTIIVMNWFQAAQPALLYIVPGVIGFLAVHCIWNGEVKPLLEFDESKTSAESSSVDSSKQDRDSALVDGKPDHKSD

SEQ ID NO: 5508 - protein, 253 aa, Primula obconica
MRNSERAANIALAGLSLAPLVIKVDPNLNVILTACLTVFVGCYRSVKPTPPSETMSNEHAMRFPFVGSAVLLSLFLLFKFLSKDLVNAVLTSYFFVLGTIALSATVLPAIQRFLPKQWNEDVIKWHFPYFSSLDVEFTRSQVVAAIPGFFFCAWYASQKHWLANNVLGLAFCIQGIEMLSLGSFKTGVILLSGLFVYDVFWVFFTPVMVSVAKSFDAPIKSFVSDCKFFSSIFDAWTWRYSYSRNLCSIGIAF

SEQ ID NO: 5509 - protein, 343 aa, Castanea mollissima
MKSVERIANVALAGLTLAPLVMKVDPNLNVILTASLTVFVGCYRSVKPTPPSETMSNEHAMRFPFVGSAMLLSLFLLFKFLSKDLVNAVLTCYFFVLGIVALSATLLPAIKRYLPTHWNQDVISWHFPYFRSLDVEFTRSQIVAAIPGTFFCAWYASQKHWLANNILGLSFCIQGIEMLSLGSFKTGAILLAGLFVYDIFWVFFTPVMVSVAKSFDAPIKLLFPTADTARPYSMLGLGDIVIPGIFVALALRFDVSRGKHSQYFRSAFLGYSVGLVLTIVVMNWFQAAQPALLYIVPSVIGFLAAHCIWNGEVKPLLAFDESKAANSSEESIDSDANSSKKLE

SEQ ID NO: 5510 - protein, 342 aa, Mimulus guttatus
MKNHERLANLALAALTFAPLVVKVDPNLNVILTACLTVYVGCYRSVKATPPTETMSNEHAMRFPLVGSAMLLSLFLLFKFLSKDLVNAVLTCYFFVLGIAALSATLLPAIKRFLPNPWNDNVIVWRFPYFRSLEVEFTKSQIIAAIPGTFFCVWYASKKHWLANNILGLAFCIQGIEMLSLGSFKTGAILLAGLFVYDIFWVFFTPVMVSVAKSFDAPIKLLFPTSDAARPFSMLGLGDIVIPGIFVALALRFDVSRGKESQYFKSAFVGYTAGLVATIIVMNWFQAAQPALLYIVPGVIGFLAAHCLWNGEVKPLLAFDESKTEETSSEETSEADSNKKAD

SEQ ID NO: 5511 - protein, 342 aa, Arachis hypogaea
MKNTERVAFLALAGLTLAPLAVKVDPNLNVILTACLTVFVGCYRSVKPTPPTETMSNEHAMRFPFVGSAMLLSLFLLFKFLSKDLVNAVLTAYFIVLGIVALSATLLPSIKRYLPKKWNEDVIVWRFPYFRSLEIEFTRSQIVAAIPGTFFCVWYALRKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKQPQYFKSAFLGYTTGLVLTIVVMNWFQAAQPALLYIVPCVIGFLAAHCLWNGEVKQLLDFNESKSADSSSQEGTDAKASKKVE

SEQ ID NO: 5512 - protein, 357 aa, Medicago truncatula
MKNVERIANLALAALTLAPLVVKINPNLNVILTACITVFVGCYRSVKPTPPSETMSNEHAMRFPFVGSAMLLSLFLLFKFLSKDLVNTVLTLYFFVLGIVALSATLLPYIKRFLPKPWNDDLIVWHFPYFRSLEIEFTKSQIIAAIPGTFFCGWYALKKHWLANNILGLAFCIQGIEMLSLGSFKTGAILLVGLFFYDIFWVFFTPVMVSVAKSFDAPIKLLFPTADSKRPFSMLGLGDIVIPGIFVALALRFDVSRGKQPQYFKSAFLGYTFGIGLTIFVMNWFQAAQPALLYIVPAVIGFLAAHCIWNGDVKQLLEFDESKTAKSSEEESDAAKSSEKIEPSGEESDAKSSKKDE

SEQ ID NO: 5513 - protein, 341 aa, Flaveria ramosissima
MKSGERAANIALAGLTLAPLVLKVDPNINVILTACLTVFVGCYRSVKPTPPSETMSNAHAMRFPLVGSAMLLSLFLLFKFLSKDLVNAVLTCCFFVLGILALSATLLPAIRRFLPTKWNEDVIHWSFPYFKSLDVEFTRSQVVAAVPGTFFCVWYVAQKHWLANNILGLAFCIQGIEMLSLGSFKTGAILLAGLFFYDIFWVFFTPVMVSVAKSFDAPIKLLFPTGVAARPFSMLGLGDIVIPGIFVALALRFDVSRGRNNQYFKSAFLGYAVGVVLTIVVMNWFQAAQPALLYIVPAVIGFLAAHCIWNGEVKPLLEFDESKTAISSDGDADENTSKKVE

SEQ ID NO: 5514 - protein, 341 aa, Manihot esculenta
MKNNERLANFALAGLTLAPLLVKVDPNLNVVLTACLTVYVGCYRSVKPTPPSETMSNEHAMRFPFVGSAMLLSLFLLFKFLSKDLVNAVLTCYFFALGIIALSATLLPAIKRYLPNHWNDDLITWHFPFFHSLEIEFTRSQIVAAIPGTFFCAWYASQKHWLANNILGLAFSIQGIEMLSLGSFKTGAILLAGLFVYDIFWVFFTPVMVSVAKSFDAPIKLLFPTRDAARPFSMLGLGDIVIPGIFVALALRFDVSRGKGSQYFKSAFLGYTVGLVLTIVVMNWFQAAQPALLYIVPSVIGFLAAHVIWNSEVKQLMEFDESKSAASSKDSSETKAGKKVE

SEQ ID NO: 5515 - protein, 337 aa, Artemisia annua
MKNVERAANIALAGLTLAPLVVKVDTNLNVILTACLTVFVGCYRSVKPTPPSETMSKEHAMRFPLVGSAMLLSLFLLFKFLSKDLVNAVLTGYFFILGIIALSATLLPAIAQYLPNKWNDDAIVWQFPYYRSLEVEFTRSQVVAAIPGTFFCAWYAAQKHWLANNILGLAFCIQGIEMLSLGSFKTGAILLAGLFVYDIFWVFFTPVMVSVAKSFDAPIKLLFPSGMVARPFSMLGLGDIVIPGIFVALALRYDVSKGKDSHYFKSAFLGYTVGLVATIIVMNWFQAAQPALLYIVPGVIGFLATHCLWNGDVKPLLEFDESKTASSEEETSSKKME

SEQ ID NO: 5516 - protein, 339 aa, Vigna unguiculata
MKKTERIANLALTGLTLAPLVVKVDPNLNVILTACLTVFVGCYRSVKPTPPTETMSNEHAMRFPFVGSAMLLSLFLLFKFLSKDLVNTVLTGYFFVLGIVALSATLLPFIKRFLPKHWNEDVIVWRLPYFRSVEIEFTRSQVVAGIPGTFFCAWYALRKHWLANNILGLAFCIQGIEMLSLGSFKTGAILLAGLFVYDIFWVFFTPVMVSVAKSFDAPIKLLFPTADAVRPFSMLGLGDIVIPGIFVALALRFDVSRGKQPQYFKSAFVGYTVGLVLTIVVMNWFQAAQPALLYIVPSVIGFLAAHCIWNGDVKQLLEFDESKTANSPQEQDKSSKKVV

SEQ ID NO: 5517 - protein, 209 aa, Olea europaea
MKNHERLANLALAGLTFAPLIVKVDPNLNVVLTACLAVYVGCYRSVKPTPPSETMSNEHAMRFPLVGSAVLLSLFLLFKFLSKDLVNAVLTCYFILLGIVALSATLLPAIKRFLPKPWNDNVIHWQFPYFRSVEVEFTRSQIVAAIPGTFFCAWYASKKHWLANNILGLAFCIQGIEMLSLGSFKTGAILLAGLFIYDIFWVFFYSSNG

SEQ ID NO: 5518 - protein, 181 aa, Vinca minor
MKNHERLANIALAGLTFAPLFVKVDPNVNVILTACLTVYVGCYRSVKSTPPTETMSNEHAMRFPLVGSAMLLSLFLLFKFLSKDLVNAVLTCYFFVLGIVALSATLLPAIKRFLPKHWNEDVITWRFPLIHSLEVEFTRSQVVAAIPGAFFLCLVRLQRSIGCLTTYWGLHSPFRGLKCFH

SEQ ID NO: 5519 - protein, 332 aa, Citrus clementina
MAAGLTLAPLLVKVDPNLNVILTACLTVYVGCYRSVKPTPPSETMSNEHAMRFPFVGSAMLLSLFLLFKFLSKDLVNAVLTCYFFVLGIIALSATILPAVKRFLPNHWNEDLIIWHFPYFRSLEIEFTRSQIIAAIPGTFFCAWYASQKHWLANNTLGLAFCIQGIEMLSLGSFKTGAILLAGLFVYDIFWVFFTPVMVSVAKSFDAPIKLLFPTRDTARPFSMLGLGDIVIPGIFVALALRFDVSRGKGSRYFKSAFLGYTVGLVLTIIVMNWFQAAQPALLYIVPAVIGFLAAHCIWNGEVKQLLEFDESKTAAVVSQESSDAKTSKKVE

SEQ ID NO: 5520 - protein, 341 aa, Euonymus alatus
MKNFERIANFALAGLTLAPLVMKVDPNLNVILTACLTVYVGCYRSVKPTPPSETMSNEHAMRFPFVGSAMLLSLFLLFKFLSKDLVNAVLTCYFFVLGIAALSATLLPSIKRFLPNHWNNNSIVWHFPYIRALEIEFTISQIIAAIPGTFFCAWYAYQKHWLANNTLGLAFCIQGIEMLSLGSFKTGAILLAGLFIYDIFWVFFTPVMVSVAKSFDAPIKLLFPTADSARPFSMLGLGDIVIPGIFVALALRFDVSRGRESQYFKSAFLGYTVGLVLTIVVMNWFQAAQPALLYIVPCVIGFLAAHCIWNGEVKQLLEFDESKAAASSSEEVSDAKSSKVE

SEQ ID NO: 5521 - protein, 319 aa, Centaurea maculosa
  misc_feature (10)..(10): Xaa can be any naturally occurring amino acid
MKSGERAANXALAGLTLAPLVLKVDPNINVILTACLTVFVGCYRSVKPTPPSETMSNEHAMRFPLVGSAMLLSLFLLFKFLSKDLVNAVLTAYFFVLGILALSATLLPAIRRFLPTKWNEDVITWHFPRFRSLDVEFTRSQVVAAIPGTFFCVWYVAQKHWLANNILGLAFCIQGIEMLSLGSFKTGAILLTGLFVYDIFWVFFTPVMVSVAKSFDAPIKLLFPTRDAVRPFSMLGLGDIVIPGIFVALALRFDVSRGRTSHYFKSAFLGYAVGVILTIIVMNWFQAAQPALLYIVPAVIGFLAAHCIWNGGGQTVIGV

SEQ ID NO: 5522 - protein, 89 aa, Cucurbita pepo
MKNAERIANFALAGLTLAPLVMKVDPNVNVVLTACLTVYVGCYRSVKPTPPSETMSSEHAMRFPFVGSAMLLSLFCFSSFYLRTWLMQS

SEQ ID NO: 5523 - protein, 341 aa, Cajanus cajan
MKNTERIANLALAGLTLAPLVVKVDSNVNVILTACLTVYVGCYRSVKPTPFTETMSNEHAMRFPFVGSAMLLSLFLLFKFLSKDLVNTVLTGYFFLLGIFSLSATLLPSIKRFLPKPWNEDLIVWRFPYFRSLEIEFTKSQIVAAIPGTFFCVWYAWWKHWLANNILGLAFCIQGIEMLSLGSFKTGAILLAGLFVYDIFWVFFTPVMVSVAKSFDAPIKLLFPTADSARPFSMLGLGDIVIPGIFVALALRFDVSRGKQPQYFKSAFLGYTAGLALTIVVMNWFQAAQPALLYIVPCVIGFLAAHCIWNADVKQLLDFDESKSAKSSQEDSDDTSSKKVE

SEQ ID NO: 5524 - protein, 341 aa, Tripterygium wilfordii
MKNCERIANFALAGLTLAPLIMKVDPNLNVILTACLTVYVGCYRSVKPTPPSETMSNEHAMRFPFVGSAMLLSLFLLFKFLSKDLVNAVLTCYFFVLGIVALSATLLPSIKRFLPKHWNDDAIVWRFPYIRALEIEFTRSQIIAAIPGTFFCAWYASQKHWLANNTLGLAFCIQGIEMLSLGSFKTGAILLAGLFVYDIFWVFFTPVMVSVAKSFDAPIKLLFPTADSARPYSMLGLGDIVIPGIFVALALRFDVSRGKESQYFKSAFLGYTAGLVLTIVVMNWFQAAQPALLYIVPCVIGFLAAHCIWNGEVKQLLEFDESKAAASSSEEVSDAKSSKVE

SEQ ID NO: 5525 - protein, 358 aa, Triphysaria pusilla
MKNHERLANLALAGLTLAPLVVKVDPNLNVILTACLTVYVGCYRSVKATPPTETMSNEHAMRFPLVGSAMLLSLFLLFKFLSKDLVNAVLTCYFFVLGIAALSATLLPAIKQYLPKPWNDNVITWRFPYFKSLEVEFTKSQIIAAIPGTFFCVWYASKKHWLANNILGLAFCIQGIEMLSLGSFKTGGILLVGLFFYDIFWVFFTPVMVSVAKSFDAPIKLLFPTADAVRPFSMLGLGDIVIPGIFVALALRFDVSRGKGSQYFKSAFVGYAVGLVATIIVMNWFQAAQPALLYIVPGVIGFLAAHTLWNGEVKPLLAFDESKTEETDEDSSKKANETDEDSSKKANETEPESDKKTD

SEQ ID NO: 5526 - protein, 344 aa, Artemisia annua
MMNGERVANIALAGLTLAPLVMKVDPNINVILTACLAVFVGCYRSVKSTPPTETMSKAHAMRFPLVGSAMLLSLFLLFKFLSKDLVNAVLTSYFFVLGILALSATLLPAIRRFLPTKWNEDVISLHFPYFRSYAPLDVEFTRSQVVAAIPGTFFCVWYVAEKHWLANNILGLAFCIQGIEMLSLGSFKTGGILLVGLFFYDIFWVFFTPVMVSVAKSFDAPIKLLFPTRVVARPYSMLGLGDIVIPGIFVALALRFDVSRGSKSNYFKSAFSGYAVGVTLTIVVMNWFQAAQPALLYIVPAVIGFLAAHCIWNGDVKPLLEFDESKTVASGDGDADETTSKKLE

SEQ ID NO: 5527 - protein, 348 aa, Eschscholzia californica
MVTSERVANLALAGLSLAPLVVKVDPNLNVILTACLAVYVGCYRSVKPTPPTETMSKEHAMRFPLVGSAMLLSLFLLFKFLSKDLVNAVLTCYFFVLGIIALGATLLPAISRFLPKLWNDDLIVWHLPYFRSVEIEFTRSQIVAAIPGFFFCAWYAKQKHWLANNVLGLAFCIQGIEMLSLGSFKTGGILLAGLFVYDIFWVFFTPVMVSVAKSFDAPIKLLFPTADATRPYSMLGLGDIVIPGIFVALALRFDVSRGKNNRYFRSAFFGYTLGLVLTIVVMNWFQAAQPALLYIVPAVIGSVAVHCIWNGEVKPLLEFDESKTATDATKDGESSNSSDDSKSSKKDE

SEQ ID NO: 5528 - protein, 276 aa, Cichorium intybus
MKNGERAANIALAGLTLAPLVVKVDTNLNVILTACLTVFVGCYRSVKPTPPSETMSNEHAMRFPLVGSAMLLSLFLLFKFLSKDLVNAVLTGYFFILGIIALSATLLPAIARFLPNKWNDDVIIWRLPYFRSLDVTFEFTRSQAFAAIPGTFFCAWYAAQKHWLANNILGLAFCIQGIEMLSLGSFKTGAILLAGLFVYDIFWVFFTPVMVSVAKSFDAPIKLLFPSRIAARPFSMLGLGDIVIPGIFVALALRYDVSRGKESHYFKSAFWDTQLA

SEQ ID NO: 5529 - protein, 341 aa, Momordica charantia
MKNAERIANFALAGLTLAPLVMKVDPNLNVVLTACLTVYVGCYRSVKPTPPSETMSSEHAMRFPFVGSAMLLSLFLLFKFLSKDLVNAVLTCYFFVLGILALSATLLPAIKRYLPDHWNQDAIVWRFPYFRALEIDFTRSQIVAAIPGTFFCAWYAMKKHWLANNILGLAFCIQGIEMLSLGSFKTGAILLAGLFVYDIFWVFFTPVMVSVAKSFDAPIKLLFPTADAARPFSMLGLGDIVIPGIFVALALRFDALRGRDGQYFKSAFLGYTVGLVLTIIVMNWFQAAQPALLYIVPAVIGFLAAHVIWNGEVKPLLEFDESKSGVSCEEGGDDDKGGKKE

SEQ ID NO: 5530 - protein, 337 aa, Ambrosia trifida
MKNGERAANIALAGLTLAPLVIKVDTNVNVILTACLTVFVGCYRSVKPTPPTETMSNEHAMRFPLVGSAMLLSLFLLFKFLSKDLVNAVLTGYFFILGIIALSATLLPAIARFLPNKWNDDVITWRFPYFRSVEFEFTRSQVVAAIPGTFFCAWYAAQKHWLANNILGLAFCIQGIEMLSLGSFKTGAILLSGLFVYDIFWVFFTPVMVSVAKSFDAPIKLLFPSRIAARPFSMLGLGDIVIPGIFVALALRYDVSRGKESHYFKSAFLGYTAGLVCTIVVMNWFQAAQPALLYIVPGVIGFLAVHCLWNGEVKPLLEFNESKAASSEEETSSKKLE

SEQ ID NO: 5531 - protein, 337 aa, Flaveria ramosissima
MKNGERAANIALAGLTLAPLVVKVDTNLNVILTACLTVFVGCYRSVKPTPPSETMSSEHAMRFPLVGSAMLLSLFLLFKFLSKDLVNAVLTGYFFILGIIALSATLLPAIGRFLPNKWNDDVIIWRFPYFRSVEVEFTRSQVVAAIPGTFFCAWYAAQKHWLANNILGLAFCIQGIEMLSLGSFKTGAILLSGLFVYDIFWVFFTPVMVSVAKSFDAPIKLLFPSRIDTRPFSMLGLGDIVIPGIFVALALRYDVSRGKESHYFKSAFLGYTVGLVCTIVVMNWFQAAQPALLYIVPGVIGFLAAHCLWNGEVKPLLEFNESKTVSSGDETSSKKLE

SEQ ID NO: 5532 - protein, 337 aa, Euphorbia peplus
MKNGERIANIALAGLTLAPLVVKVDPNLNVILTACLSVYVGCYRSVKPTPPTETMSNEHAMRFPFVGSAMLLSLFLLFKFLSKDLVNAVLTSYFFVLGIIALSATLLPAIKRYLPNSWNDDLIIWRFPYFRSLEIEFTKSQVIAAIPGTFFCAWYASKKHWLANNILGLAFCIQGIEMLSLGSFKTGAILLAGLFVYDIFWVFFTPVMVSVAKSFDAPIKLLFPTGNAARPFSMLGLGDIVIPGIFVALALRFDVSRGKESQYFKSAFFGYAFGVVLTIVVMNWFQAAQPALLYIVPAVIGCLGAHVLWNREVKPLMEFDESKTKDGGETNPAKKVE

SEQ ID NO: 5533 - protein, 339 aa, Mimulus guttatus
MKNHERMANLALAGLALAPLVVKIDPNLNVILTASLTVYVGCYRSVKATPPSETMSNEHAMRFPLVGSAMLLSLFLLFKFMSKDLVNAVLTSYFFVLGIAALSATLLPAIARFLPKPWNDNLIIWRFPYIRSLEVEFTKSQIIAAIPGTFFCAWYATKKHWLANNILGLAFCIQGIEMLSLGSFKTGAILLSGLFVYDIFWVFFTPVMVSVAKSFDAPIKLLFPTSDSARPFSMLGLGDIVIPGIFVALALRYDVSRGKESGYFRSAFLGYIVGLVLTIFVMNWFQAAQPALLYIVPAVTGFLAAHCLWNGEVKHLLEFDESKTTSSEETVADSSKKEE

SEQ ID NO: 5534 - protein, 339 aa, Plantago ovata
MKNGERLANLVLAGLTFAPLVVKVDPNLNVVLTACLAVYVGCFRSVKPTPPSETMSNEHAMRFPLVGSAMLLSLFLLFKFVPKDLVNTVLTCYFIVLGIVALSATLLPSIKRFLPNEWNDNLIVWRFPYIKALEVEFTKSQIVAAIPGTFFCVWYALKKHWLANNILGLAFCIQGIEMLSLGSFKTGAILLGGLFIYDIFWVFFTPVMVSVAKSFDAPIKLLFPTANAARPFSMLGLGDIVIPGIFVALALRFDVSRGKDGQYFKSAFVGYAVGIIATIIVMNWFQAAQPALLYIVPSVIGFLATHCLWNGEVKPLLEFDESKKSSSEETDADSTKKEE

SEQ ID NO: 5535 - protein, 339 aa, Plantago ovata
MKNGERLANLVLAGLTFAPLVVKVDPNLNVVLTACLAVYVGCFRSVKPTPPSETMSNEHAMRFPLVGSAMLLSLFLLFKFVPKDLVNTVLTCYFIVLGIVALSATLLPSIKRFLPNEWNDNLIVWRFPYIKALEVEFTKSQIVAAIPGTFFCVWYALKKHWLANNILGLAFCIQGIEMLSLGSFKTGAILLGGLFIYDIFWVFFTPVMVSVAKSFDAPIKLLFPTANAARPFSMLGLGDIVIPGIFVALALRFDVSRGKNGQYFKSAFVGYAVGIIATIIVMNWFQAAQPALLYIVPSVIGFLAAHCLWNGEVKPLLEFDESKKSSSEETDADSTKKEE

SEQ ID NO: 5536 - protein, 337 aa, Helianthus annuus
MKNGERAANIALAGLTLAPLVIKVDTNVNVILTACLTVFVGCYRSVKPTPPTETMSNEHAMRFPLVGSAMLLSLFLLFKFLSKDLVNAVLTGYFFILGIIALSATLLPAIARFLPNKWNDDLITWRLPYFRSVEIEFTRSQVVAAIPGTFFCAWYAAQKHWLANNILGLAFCIQGIEMLSLGSFKTGAILLSGLFVYDIFWVFFTPVMVSVAKSFDAPIKLLFPSRIAARPFSMLGLGDIVIPGIFVALALRYDVSRGKESHYFKSAFLGYTVGLVCTIVVMNWFQAAQPALLYIVPGVIGFLAAHCLWNGEVKPLLEFNESKAASSEEETSSKKVE

SEQ ID NO: 5537 - protein, 281 aa, Tripterygium wilfordii
MKNCERIANFALAGLTLAPLVLKVDPNLNVILTACLTVYVGCYRSVKPTPPSETMSNEHAMRFPFVGSAMLLSLFLLFKFLSKDLVNAVLTCYFFVLGIAALSATLLPSIKRFLPMHWNDNAIVWRFPYVRALEIEFTRSQIVAAIPGTFFCAWYASQKHWLANNTLGLAFCIQGIEMLSLGSFKTGVILLAGLFVYDIFWVFFTPVMVSVAKSFDAPIKLLFPTADSARPFSMLGLGDIVIPGILWHLLCALMYLEEKRASTLRVLFWDTQLAWSLQSSS

SEQ ID NO: 5538 - protein, 346 aa, Tragopogon dubius
MKSGERAANVALACLTLAPLVVKVDPNINVILTACLSVFVGCYRSVKPTPPTETMSNEHAMRFPLVGSAMLLSLFLLFKFLSKDLVNAVLTCYFFVLGIIALSATLLPAIRRFLPTKWNEDVITWRFPYFHSLDVEFTRSQVIAAIPGTFFVVWYVAQKHWLANNILGLAFCIQGIEMLSLGSFKTGAILLVGLFFYDIFWVFFTPVMVSVAKSFDAPIKLLFPTRDAARPFSMLGLGDIVIPGIFVALALRFDVSRGNKSNYFQSAFLGYAVGVILTIVVMNWFQAAQPALLYIVPSVIGFLGVHCIWNGEVKPLLEFDESKTVDGDGDGNGNGNVDEKTSKKVE

SEQ ID NO: 5539 - protein, 352 aa, Pinus pinaster
MRMNEKLASAALAVLSVAPLVVNVNPNLNVVLTACLTVYVGCYRSVKPAPPSETMSKEHAMRFPLIGSVVLVSLFLLFKFLSKDLVNAILTSYFFVLGIIALSATLLPAIERFLPKKWNESPINFHLPYFKSVEVEFTKSQLVAAIPGTFFCTWYALKKHWLANNVLGLAFCIQGIEMLSLGSFKTGAILLAGLFVYDIFWVFFTPVMVSVAKSFDAPIKLLFPTADAARPYSMLGLGDIVIPGIFVALALRFDVSREKGERYFKSAFIGYAVGVIVTIIVMNWFQAAQPALLYIVPGVIGFLAVHCIWNGEVKPLLEFDESKTSAQSSSADTSQSDGDAVVADGKPDHKSD

SEQ ID NO: 5540 - protein, 338 aa, Ambrosia trifida
MKNGERAANIALAGLTLAPLVIKVDTNVNVILTACLTVFVGCYRSVKPTPPTETMSNEHAMRFPLVGSAMLLSLFLLFKFLSKDLVNAVLTGYFFILGIIALSATLLPAIARFLPNKWNDDVITWRFPYFRSVEFEFTRSQVVAAIPGTFFCAWYAAQKHWLANNILGLAFCIQGIEMLSLGSFKTGAILLSGLFVYDIFWVFFTPVMVSVAKSFDAPIKLLFPSRIAARPFSMLGLGDIVIPGIFVALALRYDVSRGKESHYFKSAFLGYTAGLVCTIVVMNWFQAAQPALLYIVPGVIGFLAVHCLWNGDVKPLLEFNESKAAASSEEETSSKKLE

SEQ ID NO: 5541 - protein, 339 aa, Cirsium arvense
MKSGERAANIALAGLTLAPLVLKVDPNINVILTACLTVFVGCYRSVKPTPPSETMSNEHAMRFPLVGSAMLLSLFLLFKFLSKDLVNAVLTSYFFVLGILALSATLLPAIRRFLPTKWNEDVITWRFPHFHSLDVEFTRSQAVAAIPGTFFCVWYVAQKHWLANNILGLAFCIQGIEMLSLGSFKTGAILLAGLFFYDIFWVFFTPVMVSVAKSFDAPIKLLFPTRDAVRPFSMIGLGDIVIPGIFVALALRFDVSRGRKSHYFKSSFLGYAVGVILTILVMNWFQAAQPALFYIVPAVIGFLAAHCIWNGEVKPLLEFDESKSAIVDSDIDEKTNKIE

SEQ ID NO: 5542 - protein, 337 aa, Flaveria ramosissima
MKNGERAANIALAGLTLAPLVVKVDTNINVVLTACLTVFVGCYRSVKPTPPSETMSSEHAMRFPLVGSAMLLSLFLLFKFLSKDLVNAVLTGYFFILGIIALSATLLPAIGRFLPNKWNDDVIIWRFPYFRSVEVEFTRSQVVAAIPGTFFCAWYAAQRHWLANNILGLAFCIQGIEMLSLGSFKTGAILLSGLFVYDIFWVFFTPVMVSVAKSFDAPIKLLFPSRIDTRPFSMLGLGDIVIPGIFVALALRYDVSRGKESHYFKSAFLGYTVGLVCTIVVMNWFQAAQPALLYIVPGVIGFLAAHCLWNGEVKPLLEFNESKTVSSGDETSSKKLE

SEQ ID NO: 5543 - protein, 337 aa, Flaveria ramosissima
MKNGERAANIALAGLTLAPLVVKVDTNINVVLTACLTVFVGCYRSVKPTPPSETMSSEHAMRFPLVGSAMLLSLFFLFKFLSKDLVNAVLTGYFFILGIIALSATLLPAIGRFLPNKWNDDVIIWRFPYFRSVEVEFTRSQVVAAIPGTFFCAWYAAQKHWLANNILGLAFCIQGIEMLSLGSFKTGAILLSGLFVYDIFWVFFTPVMVSVAKSFDAPIKLLFPSRIDTRPFSMLGLGDIVIPGIFVALALRYDVSRGKESHYFKSAFLGYTVGLVCTIVVMNWFQAAQPALLYIVPGVIGFLAAHCLWNGEVKPLLEFNESKTVSSGDETSSKKLE

SEQ ID NO: 5544 - protein, 339 aa, Lippia dulcis
MKNHERVANLALAGLTLAPLFVKVDPNLNVILTACLAVYVGCYRSVKPTPPSETMSNEHAMRFPLIGSAMLLSLFLLFKFLSKDLVNAVLTCYFFVLGIVALSATLLPAIKKFLPKEWNDNLIIWRFPYIRSLEVEFTKSQIIAAIPGFFFCAWYASKKHWLANNILGLAFCIQGIEMLSLGSFKTGAILLTGLFLYDIFWVFFTPVMVSVAKSFDAPIKLLFPTSNSARPFSMLGLGDIVIPGIFVALALRFDVSRGKDGQYFKSAFAGYTVGLVLTIVVMNWFQAAQPALLYIVPAVIGFLAAHCLWNGEVKPLLEFDESKTTGSKESEAESTKKED

SEQ ID NO: 5545 - protein, 347 aa, Euonymus alatus
MKNCERIANFALAGLTLAPLVMKVDPNLNVILTASLTVYVGCYRSVKPTPPSETMSNEHAMRFPFVGSAMLLSLFLLFKFLSKDLVNAVLTCYFFVLGIAALSATLLPSIKRFLPNHWNNNSIVWRFPYIRALEIEFTRSQIIAAIPGTFFCAWYAYQKHWLANNTLGLAFCIQGIEMLSLGSFKTGAILLAGLFIYDIFWVFFTPVMVSVAKSFDAPIKLLFPTADSARPFSMLGLGDIVIPGIFVALALRFDVSRGKESQYFKSAFLGYTIGLVLTIVVMNWFQAAQPALLYIVPCVIGFLAAHCILNGEVKQLLAFDESKTAGSSSEEVSDAKSLSEEVSKKVE

SEQ ID NO: 5546 - protein, 344 aa, Aquilegia formosa
MISSERVANLALAGLTLAPLVVNVNPNLNVILTACLTVYVGCYRSVKPTPPAETMSNEHAMRFPLIGSAMLLSLFLLFKFLSKDLVNAVLTCYFFVLGILALSATLLPAIARFLPKKWNDNLISWRLPYFRSVEIEFTISQCIAAIPGTFFCAWYAKQKHWLANNILGLAFCIQGIEMLSLGSFKTGGILLAGLFVYDIFWVFFTPVMVSVAKSFDAPIKLLFPTGDSARPFSMLGLGDIVIPGIFVALALRFDVSRGKKNRYFRSAFFGYTVGLVLTIVVMNWFQAAQPALLYIVPAVIGFLAVHCIANGEVKPLLEFDESKTEGSEDGESSGKDEKSSKKEE

SEQ ID NO: 5547 - protein, 352 aa, Abies balsamea
MRINEKLASAALAVLSLAPLVIKVNPNLNVVLTACLTVYVGCYRSVKPAPPSETMSKEHAMRFPLIGSVVLVSLFLLFKFLSKDLVNAILTSYFFVLGIIALSATLLPAIERFLPKKWNELPINWHLPYFKSVEVEFTKSQLVAAIPGTFFCTWYALKKHWLANNVLGLAFCIQGIEMLSLGSFKTGAILLAGLFVYDIFWVFFTPVMVSVAKSFDAPIKLLFPTADAARPYSMLGLGDIVIPGIFVALALRFDVSREKGERYFRSAFIGYSVGVIVTIIVMNWFQAAQPALLYIVPGVIGFLAVHCIWNGEVKPLLEFDESKTSAQSSSADTSQSDGDTVVADGKPDHKSD

SEQ ID NO: 5548 - protein, 352 aa, Sciadopitys verticillata
MKTSDKLANLALAGLSLAPLVVKVNPNLNVVMTACLTVYIGCHRSVKPAPPSETMSKEHAMRFPFIGSVVLFSLFLLFKFLSKDFVNAILTCYFFVLGIIAFSATLLPAIERFLPRGWNEMPINWHLPYFRSVEVEFTKSQVAAAIPGTFFCTWYALKKHWLANNILGLAFCIQGIEMLSLGSFKTGAILLAGLFVYDIFWVFFTPVMVSVAKSFDAPIKLLFPTADMTRPYSMLGLGDIVIPGIFVALALRFDVSRGKGERYFRSAFFGYTVGLIVTIIVMNWFQAAQPALLYIVPGVIGFLAVHCIWNGEVKPLLEFDESKTSSESNSVDSAKQETDSALVDGKPDHKSD

SEQ ID NO: 5549 - protein, 338 aa, Ambrosia trifida
MKNGERAANIALAGLTLAPLVIKVDTNVNVILTACLTVFVGCYRSVKPTPPTETMSNEHAMRFPLVGSAMLLSLFLLFKFLSKDLVNAVLTGYFFILGIIALSATLLPAIARFLPNKWNDDVITWRFPYFRSVEFEFTRSQVVAAIPGTFFCAWYAAQKHWLANNILGLAFCIQGIEMLSLGSFKTGAILLSGLFVYDIFWVFFTPVMVSVAKSFDAPIKLLFPSRIAARPFSMLGLGDIVIPGIFVALALRYDVSRGKESHYFKSAFLGYTAGLVCTIVVMNWFQAAQPALLYIVPGVIGFLAAHCLWNGDVKPLLEFNESKAAASSEEETSSKKLE

SEQ ID NO: 5550 - protein, 338 aa, Quercus alba
MKSVERIANVALAGLTLAPLVMKVDPNLNVILTASLTVFVGCYRSVKPTPPSETMSNEHAMRFPFVGSAMLLSLFLLFKFLSKDLVNAVLTCYFFVLGIVALSATLLPAIKRYLPTHWNQDVISWRFPYFRSLDVEFTRSQIVAAIPGTFFCAWYASQKHWLANNILGLSFCIQGLGSFKTGAILLAGLFVYDIFWVFFTPVMVSVAKSFDAPIKLLFPTADTARPYSMLGLGDIVIPGIFVALALRFDVSRGKHSQYFRSAFLGYSVGLVLTIVVMNWFQAAQPALLYIVPCVIGFLAAHCIWNGEVKPLLAFDESKAANSSEESSDSDANSSKKEE

SEQ ID NO: 5551 - protein, 313 aa, Capsicum annuum
NVNVIVTACLTVFVGCCRSVKPTPPSETMSNEHAMRFPLVGSAMLLSLFLLFKFLSKDLVNAVLTCYFFVLGIAALSATLLPSIKRFLPKKWNDNLIIWHFPYFRSLEIEFTRSQIIAAIPGTIFCVWYARQKHWLANNVLGLAFCIQGIEMLSLGSFKTGAILLGGLFVYDIFWVFFTPVMVSVAKSFDAPIKLLFPTADAKRPFSMLGLGDIVIPGIFVALALRFDVSRGKEPQYFKSAFLGYTFGLALTIFVMNWFQAAQPALLYIVPAVIGFLSVHCIWNGDVKPLLEFDEGKTKGAEEAEAKESKKVE

SEQ ID NO: 5552 - protein, 335 aa, Eutrema halophilum
MKNCERFANLALAGLTLAPLVVRVNPNLNVILTACLTVYVGCFRSVKDSPPTETMSKEHAMRFPLVGSAMLLSLFLLFKFLSKDLVNAVLTAYFFVLGIVALSATLLPAIRRFLPNPWNDNLIVWRFPYFRSLEVEFTKSQVVAGIPGTFFCAWYAWKKHWLANNILGLSFCIQGIEMLSLGSFKTGAILLVGLFFYDIFWVFFTPVMVSVAKSFDAPIKLLFPTGDALRPYSMLGLGDIVIPGIFVALALRFDVSRRSQPQYFTSAFVGYIAGVVLTIVVMNWFQAAQPALLYIVPAVIGFLASHCFWNGDIKPLMAFDESKTTEAEVNKTHEE

SEQ ID NO: 5553 - protein, 337 aa, Flaveria ramosissima
MKNGERAANIALAGLTLAPLVVKVDTNINVVLTACLTVFVGCYRSVKPTPPSETMSSEHAMRFPLVGSAMLLSLFLLFKFLSKDLVNAVLTGYFFILGIIALSATLLPAIGRFLPNKWNDDVIIWRLPYFRSVEVEFTRSQVVAAIPGTFFCAWYAAQKHWLANNILGLAFCIQGIEMLSLGSFKTGAILLSGLFVYDIFWVFFTPVMVSVAKSFDAPIKLLFPSRIDTRPFSMLGLGDIVIPGIFVALALRYDVSRGKESHYFKSAFLGYTVGLVCTIVVMNWFQAAQPALLYIVPGVIGFLAAHCLWNGEVKPLLEFNESKAVSSGDETNIKKLE

SEQ ID NO: 5554 - protein, 346 aa, Arnica chamissonis
MKNGERAANIALAGLTLAPLVVKVDTNINVILTACLTVFVGCYRSVKPTPPSETMSNEHAMRFPLVGSAMLLSLFLLFKFLSKDLVNAVLTGYFFILGIIALSATLLPAIGRFLPNKWNEDVIIWRFPYFRSVEVEFTRSQVVAAIPGTFFCAWYAAQKHWLANNILGLAFCIQGIEMLSLGSFKTGAILLSGLFVYDIFWVFFTPVMVSVAKSFDAPIKLLFPSRIATRPFSMLGLGDIVIPGIFVALALRYDVSRGKESHYFKSAFLGYTVGLVCTIVVMNWFQAAQPALLYIVPGVIGFLAAHCLWNGEVKPLLEFNESKTAGSEDESKTAGSEDETSSKKLE

SEQ ID NO: 5555 - protein, 335 aa, Unknown
  Sequence found in Organisms: Brassica napus, Brassica rapa
MKNCERIANLALAGLTVAPLVVRVNPNLNVVLTACLTVYVGCFRSVKDSPPTETMSKEHAMRFPLVGSAMLLSLFLLFKFLSKDLVNAVLTAYFFVLGIVALSATLLPAISRFLPKPWNDNLIVWRFPYFKSLEVEFTKSQVIAGIPGTFFCAWYAWKKHWLANNILGLSFCIQGIEMLSLGSFKTGAILLVGLFFYDIFWVFFTPVMVSVAKSFDAPIKLLFPTGDALRPYSMLGLGDIVIPGIFVALALRFDVSRRSKPQYFTSAFVGYVAGVVLTIVVMNWFQAAQPALLYIVPAVIGFLASHCIWNGDIKPLMAFDESKTTEGEVDKAHEE

SEQ ID NO: 5556 - protein, 335 aa, Brassica napus
MKNCERIANLALAGLTVAPLVVRVNPNLNVVLTACLTVYVGCFRSVKDSPPTETMSKEHAMRFPLVGSAMLLSLFLLFKFLSKDLVNAVLTAYFFVLGIVALSATLLPAISRFLPKPWNDNLIVWRFPYFKSLEVEFTKSQVIAGIPGTFFCAWYAWKKHWLANNILGLSFCIQGIEMLSLGSFKTGAILLVGLFFYDIFWVFFTPVMVSVAKSFDAPIKLLFPTGDALRPYSMLGLGDIVIPGIFVALALRFDVSRRSKPQYFTSAFLGYVAGVVLTIVVMNWFQAAQPALLYIVPAVIGFLASHCIWNGDIKPLMAFDESKTTEGEVDKAHEE

SEQ ID NO: 5557 - protein, 350 aa, Chelidonium majus
MRTSERVANLALAGLTLAPLVVKVDPNLNVILTASLAVYVGCYRSVKPTPPSETMSNEHAMRFPLVGSAMLLSLFLLFKFLSKDLVNAVLTCYFFVLGIIALSATLVPAISRFLPKKWNDDLIVWHLPYFRSVEVEFTRSQIVAAIPGTFFCAWYVQQKHWLANNVLGLAFCIQGIEMLSLGSFKTGAILLAGLFVYDIFWVFFTPVMVSVAKSFDAPIKLLFPTADAARPYSMLGLGDIVIPGIFVALALRFDVSRGKDNRYFRSAFFGYMLGLVLTIVVMNWFQAAQPALLYIVPAVIGCMAVHCLWNGEVKPLLEFDESKTAAAASSQDGESSSSGDDDSKSSKKEE

SEQ ID NO: 5558 - protein, 343 aa, Unknown
  Sequence found in Organisms: Brassica napus, Brassica rapa
MKNCERIANLALAGLTVAPLVVNVNPNLNVVLTACLTVYVGCFRSVKDSPPTETMSKEHAMRFPLVGSAMLLSLFLLFKFLSKDLVNAVLTAYFFVLGIVALSATLLPAISRFLPKPWNDNLIVWRFPYFKSVEVEFTKSQVIAGIPGTFFCAWYAWKKHWLANNILGLSFCIQGIEMLSLGSFKTGAILLVGLFFYDIFWVFFTPVMVSVAKSFDAPIKLLFPTGDALRPYSMLGLGDIVIPGIFVALALRFDVSRRSKPQYFTSAFVGYVAGVVLTIVVMNWFQAAQPALLYIVPAVIGFLASHCIWNGDIKPLMAFDESSKSTEEESKSSEGEVNKSHAE

SEQ ID NO: 5559 - protein, 343 aa, Brassica napus
MKNCERIANLALAGLTVAPLVVNVNPNLNVVLTACLTVYVGCFRSVKDSPPTETMSKEHAMRFPLVGSAMLLSLFLLFKFLSKDLVNAVLTAYFFVLGIVALSATLLPAISRFLPKPWNDNLIVWRFPYFKSVEVEFTKSQVIAGIPGTFFCAWYAWKKHWLANNILGLSFCIQGIEMLSLGSFKTGAILLVGLFFYDIFWVFFTPVMVSVAKSFDAPIKLLFPTGDALRPYSMLGLGDIVIPGIFVALALRFDVSRRSKPQYFTSAFVGYVAGVVLTIVVMNWFQAAQPALLYIVPAVIGFLASHCIWNGDIKPLMAFDESSKSTEEESKSSEGEVNKSHEE

SEQ ID NO: 5560 - protein, 341 aa, Utricularia gibba
MKNHERLANLALAGLALAPLAVKVDPNVNVILTACLTVYVGCYRSVKPTPPAEAMSNAHAMRFPFVGSAMLLSLFLLFKFLSKDLVNAVLTCYFFVLGVAALSATLLPAIKKFLPQPWNDNVIMWRFPFVKSFDVEFTISQIVSAIPGTAFCVWYASKKHWLANNILGLAFCIQGIEMLSLGSFKTGAILLAGLFFYDIFWVFFTPVMVSVAKSFDAPIKLLFPTSDSTRPFSMLGLGDIVIPGIFVALALRFDVSRGKESQYFKSAFVGYTAGLGLTIFVMNWFQAAQPALLYIVPAVIGFLAAHCIWNGDVKPLLAFDETKTAESQEEAETSEVDKKTE

SEQ ID NO: 5561 - protein, 344 aa, Arabidopsis lyrata
MKNCERFANLALAGLTLAPLVVRVNPNLNVILTACITVYVGCFRSVKDTPPTETMSKEHAMRFPLVGSAMLLSLFLLFKFLSKDLVNAVLTAYFFVLGIVALSATLLPAIRRFLPNPWNDNLIVWRFPYFKSLEVEFTKSQVVAGIPGTFFCAWYAWKKHWLANNILGLSFCIQGIEMLSLGSFKTGAILLAGLFFYDIFWVFFTPVMVSVAKSFDAPIKLLFPTGDALRPYSMLGLGDIVIPGIFVALALRFDVSRRRQPQYFTSAFIGYAVGVILTIVVMNWFQAAQPALLYIVPAVIGFLASHCIWNGDIKPLLAFDESKTEEPKTDESKTSEEGNKAHDE

SEQ ID NO: 5562 - protein, 344 aa, Arabidopsis thaliana
MKNCERFANLALAGLTLAPLVVRVNPNLNVILTACITVYVGCFRSVKDTPPTETMSKEHAMRFPLVGSAMLLSLFLLFKFLSKDLVNAVLTAYFFVLGIVALSATLLPAIRRFLPNPWNDNLIVWRFPYFKSLEVEFTKSQVVAGIPGTFFCAWYAWKKHWLANNILGLSFCIQGIEMLSLGSFKTGAILLAGLFFYDIFWVFFTPVMVSVAKSFDAPIKLLFPTGDALRPYSMLGLGDIVIPGIFVALALRFDVSRRRQPQYFTSAFIGYAVGVILTIVVMNWFQAAQPALLYIVPAVIGFLASHCIWNGDIKPLLAFDESKTEEATTDESKTSEEVNKAHDE

SEQ ID NO: 5563 - protein, 292 aa, Fagopyrum esculentum
MSNEHAMRFPLVGSAMLLSLFLLFKFLSKDLVNAVLTCYFFILGILALSATLLPAIKRFLPDHWNDNVIEWRFSYIKRLAFEIEFTRSQVVAAIPGTFFCAWYASKKHWLANNVLGLSFCIQGIEMLSLGSFKTGAILLGGLFFYDIFWVFFTPVMVSVAKSFDAPIKLLFPTGDAARPFSMLGLGDIVIPGIFVALALRFDVSRGKESQYFKSAFLGYFAGLALTIFVMNWFQAAQPALLYIVPAVIGFLAVHVLWNGDVKALLAFDESKTEEGASSEENSDDAKLSKKVE

SEQ ID NO: 5564 - protein, 340 aa, Amorphophallus konjac
MKTHERAANIALAGLTLAPLVVKIDPNLNVILMACLTVYVGCYRSVKPTPPSETMSNEHAMRFPIVGSAMLLSLFLLFKFLSKDLVNAVLTCYFFVLGIIALSATLLPAIKRFLPKNWNEDLIVWHLPYFPSVSVEFTKSQIVASIPGTCFCIWYASKKHWLANNILGIAFCIQGIEMLSLGSFKTGAILLGGLFIYDIFWVFFTPVMVSVAKSFDAPIKLLFPTSDAARPFSMLGLGDIVIPGIFVALALRFDVSRGKENRYFRSAFLGYTVGLILTIVVMNWFQAAQPALLYIVPGVVGFVAVHCLWNGEVKPLLEYDESKMAADPSCSEEKPEKKVD

SEQ ID NO: 5565 - protein, 336 aa, Brassica napus
MKNCERIANLALAGLTVAPLVVRVNPNLNVVLTACLTVYVGCFRSVKDSPPTETMSKEHAMRFPLVGSAMLLSLFLLFKFLSKDLVNAVLTAYFFVLGIVALSATLLPAISRFLPKPWNDNLIVWRFPYFKSLEVEFTKSQVVAGIPGTFFCAWYAWKKHWLANNILGLSFCIQGIEMLSLGSFKTGAILLVGLFFYDIFWVFFTPVMVSVAKSFDAPIKLLFPTGDALRPYSMLGLGDIVIPGIFVALALRFDVSKRSQPKYFTSAFVGYVVGVVLTIVVMNWFQAAQPALLYIVPAVIGFLASHCVWNGDIKPLLAFDESSKSTEEEVSKTHEE

SEQ ID NO: 5566 - protein, 334 aa, Brassica napus
KNCERIANLALAGLTVAPLVVRVNPNLNVVLTACLTVYVGCFRSVKDSPPTETMSKEHAMRFPLVGSAMLLSLFLLFKFLSKDLVNAVLTAYFFVLGIVALSATLLPAISRFLPKPWNDNLIVWRFPYFKSLEVEFTKSQVIAGIPGTFFCAWYAWKKHWLANNILGLSFCIQGIEMLSLGSFKTGAILLVGLFFYDIFWVFFTPVMVSVAKSFDAPIKLLFPTGDALRPYSMLGLGDIVIPGIFVALALRFDVSRRSKPQYFTSAFLGYVAGVVLTIVVMNWFQAAQPALLYIVPAVIGFLASHCIWNGDIKPLMAFDESKTTEGEVDKAHEE

SEQ ID NO: 5567 - protein, 250 aa, Solanum tuberosum
MVKPNSKDTEFSPSSSSSSLYRGVRKRKWGKWVSEIRLPNSRERIWLGSYDTPEKAAKAFDAALFCLRGKGANFNFPENPPEIMNGRSMTPSEIQSAAAQFANNTEPELIRVGPRENSDLSSSSSEIFRAESPSVSVSDRVESEKTEITLGNDFINMYRVESPVSGRVESEKTEMSLDNGFMDMFSSLGTVNDMSDFGIFPGFDDLSGEFFIPPPSPQPSQMPNLESLEEENYLNYDGFQSQGTSFLWNF

SEQ ID NO: 5568 - protein, 250 aa, Solanum phureja
MVKPNSKDTEFSPSSSSSSLYRGVRKRKWGKWVSEIRLPNSRERIWLGSYDTPEKAAKAFDAALFCLRGKGANFNFPENPPEIMNGRSMTPSEIQSAAAQFANNTEPELIRVGPRENSDLSSSSSEIFLAESPSVSVSDRVESEKTEITLGNDFINMYRVESPVSGRVESEKTEMSLDNGFMDMFSSLGTVNDMSDFGIFPGFDDLSGEFFIPPPSPQPSQMPNLESLEEENYLNYDGFQSQGTSFLWNF

SEQ ID NO: 5569 - protein, 95 aa, Solanum phureja
MAAQEEVKQLSECSVSNALGTWVFSVAGALLAIPVGIKRKSLAPLVFFGTTGTMLDIIMGISACEREHAERQMKLLEEAQGSAAVDTLADTATEH

SEQ ID NO: 5570 - protein, 95 aa, Solanum tuberosum
MAAQEEVKQLSECSVSNALGTWVFSVAGALLAIPVGIKRKSLAPLVFFGTTGTMLDIIMGISACEREHAERQMKLLEEAQGPAAVDTLADEATEH

SEQ ID NO: 5571 - protein, 94 aa, Capsicum annuum
MAGQEEVKQLSECSVSNALGTWVFSVAGALLAIPVGIKRKSLAPLVFFGTTGTMLDIIMGISACEREHAERQKLLEEAQRSAAVDTLADAATEH

SEQ ID NO: 5572 - protein, 84 aa, Capsicum annuum
MAGQEEVKQLSECSVSNALGTWVFSVAGALLAIPVGIKRKSLAPLVFFGTTGTMLDIIMGISACEREHAERPKAFGRSTKICSC

SEQ ID NO: 5573 - protein, 95 aa, Solanum melongena
MAAEEEVKQLAECSVSNALGTWVFSVAGALLAIPVGIKRKSLAPLVFFGTTGTMLDIIMGISACEREHAERQMKLMEEAQRSSSVDTFTDATTEH

SEQ ID NO: 5574 - protein, 95 aa, Nicotiana tabacum
  misc_feature (65)..(65): Xaa can be any naturally occurring amino acid
MAAGEEVKQLEDCTVANALGTWVFSVASALLAIPVGIKRKSLGPLVFFGTTGTMLDIIMGINACXREHAEHQMKLLEEAQRSAAVDPLADDATEH

SEQ ID NO: 5575 - protein, 90 aa, Theobroma cacao
MAGQEVKQLEECSVSNALGTWVFSVAGALLAIPVGIKRKSLAPLVFFGTTGTMLDIIMGISACEREHAERQMKLLEAQNSAADDSSVSES

SEQ ID NO: 5576 - protein, 94 aa, Unknown
  Sequence found in Organisms: Citrus sinensis, Citrus clementina, Citrus sinensis
MASQETVKQLEDCSVSNALGTWVFSVAGALLAIPVGIKRKSLAPLVFFGTTGTMLDIIMGVSACEREHAERQMKLLEAQNAAADASLTETGTET

SEQ ID NO: 5577 - protein, 94 aa, Lippia dulcis
MAGKEEVKQLEECSVSNALGTWVFSVAGALLAIPVGIKRKSLAPLVFFGTTGTMLDIIMGISACEREHAERQMQLLEAQNAVAAEADVVTESLS

SEQ ID NO: 5578 - protein, 285 aa, Gossypium hirsutum
MDDITLSLKESNVISRCKEGVSFKGKSVSNDLQIVVKEMHHVSSFTASFWSEITEFGKLQHPNLVKLIGKCRSDKGAYLVYEYVEGKLLSEILGNLSWERRWKIAIGTAKALRFLHSRCSPSVLVGDMSPERIIIDAKDEPRLQFIFPFVDNQPFLPSSYVAPEARENKKMNEKSDIYGMGLILIELLTGKTPADAEFKVQYSSMVEWARYCYSDCHLDMWVDPVIKSQASINNQNQIVAAMNLALHCTAGDPTARPCAADVFETLKSAFRTSSCLPSLNFSSPV

SEQ ID NO: 5579 - protein, 308 aa, Gossypium hirsutum
VEKGDGSIWELQFFDPKVSKSVTMDDITLSLKESNVISRCKEGVSFKGKSVSNDLQIVVKEMHHVSSFTASFWSEITEFGKLQHPNLVKLIGKCRSDKGAYLVYEYVEGKLLSEILGNLSWERRWKIAIGTAKALRFLHSRCSPSVLVGDMSPERIIIDAKDEPRLQFIFPFVDNQHFLPSSYVAPEARENKKMNEKSDIYGMGLILIELLTGKTPADAEFKVQYSSMVEWARYCYSDCHLDMWVDPVIKSQASINNQNQIVAAMNLALHCTAGDPTARPCAADVFETLKSAFRTSSCLPSLNFSSPV

SEQ ID NO: 5580 - protein, 84 aa, Catharanthus roseus
MAGQENVKQLEECSVSNALGTWVFSVAGALLAIPVGIKRKSLAPLVFFGTTGTMLDIIMGISACEREHAERQMKASGSTECWHR

SEQ ID NO: 5581 - protein, 96 aa, Gossypium hirsutum
MGGQEVKQLEECSVSNALGTWVFSVAGALLAIPVGIKRKSLAPLVFFGTTGTMLDIIMGISACEREHAERQMKLLEAQNSTADDSSFSETGSELHS

SEQ ID NO: 5582 - protein, 96 aa, Gossypium raimondii
MGGQEVKQLEECSVSNALGTWVFSVAGALLAIPVGIKRKSLAPLVFFGTTGTMLDIIMGISACEREHAERQMKLLEAQNSTADDSSFSETGSESHS

SEQ ID NO: 5583 - protein, 93 aa, Arachis hypogaea
MANEEVKHLEDCSVSNALGTWVFSVAGALLAIPVGIKRKSLAPLVFFGTTGTMLDIIMGISACEREHAERQMKLIEAQRAATDTSLVEANTDS

SEQ ID NO: 5584 - protein, 90 aa, Sesamum indicum
MAGKEEVKQLEECSVSNALGTWVFSVAGALIAIPVGIKRKSLAPLVFFGTTGTMLDIIMGISACEREHAERQMKLLEAQNAASADAVTES

SEQ ID NO: 5585 - protein, 90 aa, Amsonia hubrichtii
MAGQETVKQLEECSVSNALGTWVFSVAGALLAIPVGIKRKSLAPLVFFGTTGTMLDIIMGISACEREHAERQMKLLEAQNASTADVGAES

SEQ ID NO: 5586 - protein, 90 aa, Olea europaea
MSGKAEVKQLEECSVSNALGTWVFSVAGALLAIPVGIKRKSLAPLVFFGTTGTMLDIIMGISACEREHAERQMKLLEAQNAAAADTESES

SEQ ID NO: 5587 - protein, 112 aa, Vinca minor
PPTTAVELFCQSKNIGWLAKKIVKQLEDCSVSNALGTWVFSVAGALIAIPVGIKRKSLAPLVFFGTTGTMLDIIMGISACEREHAERQMKLLEAQNAVGTESFGTESFGTES

SEQ ID NO: 5588 - protein, 101 aa, Ipomoea nil
MAGQDAQPVKQLEECSVSNALGTWVFSVAGALLAIPVGIKRKSLAPLVFFGTTGTMLDIIMGISACEREHAERQKLLEAQNSAAAAADALPNIGAGARAES

SEQ ID NO: 5589 - protein, 95 aa, Citrullus lanatus
MGSQENVKHIEECSVSNALGTWVFSVAGALLAIPVGIKRKSLAPLVFFGTTGTMLDIIMGISACEREHAERQMKLLEEAQNSASEASINDSESHS

SEQ ID NO: 5590 - protein, 95 aa, Cucumis melo
MGSQENVKHIEDCSVSNALGTWVFSVAGALLAIPVGIKRKSLAPLVFFGTTGTMLDIIMGISACEREHAERQMKLLEEAQNSAPQSSLNDSNSHS

SEQ ID NO: 5591 - protein, 89 aa, Fraxinus spp
MSGKAEVKQLEECSVSNALGTWVFSVAGALLAIPVGIKRKSLAPLVFFGTTGTMLDIIMGISACEREHAERQMKLLEAQNAAAAVAESE

SEQ ID NO: 5592 - protein, 94 aa, Sarracenia psittacina
MAGQENVKNLEDCSVSNALGTWVFSVAGALLAIPVGIKRKSLAPLVFFGTTGTMLDIIMGISQCEREHAERQMQLLEAQNAGAASSLTETGAES

SEQ ID NO: 5593 - protein, 95 aa, Cucumis sativus
MGSQENVKHIEDCSVSNALGTWVFSVAGALLAIPVGIKRKSLAPLVFFGTTGTMLDIIMGISACEREHAERQMKLLEEAQNSATEAFLNDSNSDS

SEQ ID NO: 5594 - protein, 94 aa, Cucurbita pepo
MGSQEQVKHLEECSVSNALGTWVFSVAGALLAIPVGIKRKSLAPLVFFGTTGTMLDIIMGISACEREHAERQMKLLEAQNSAAEASVNESESLS

SEQ ID NO: 5595 - protein, 111 aa, Platanus occidentalis
NIARVERVEDKRYAEERDGRPRNVKQLEDCSVSNALGTWVFSVAGALLAIPVGIRRKSLAPLVFFGTTGTMLDIIMGISACEREHAERQMKLLEEQNLATDAAIAEPGSES

SEQ ID NO: 5596 - protein, 98 aa, Solanum tuberosum
MARSFSNSKILSAFVSDSVSAFLSRRGYAAASQGAVSGVAKGGVPRSNVMMQKSGEESVKTSWVPDPVTGYYRPEGQANEIDAAELRKMLLKHRSGSN

SEQ ID NO: 5597 - protein, 98 aa, Solanum tuberosum
MARSFSNSKILSAFVSDSVSAFLSRRGYAAASQGAVSGVAKGGVPRSNVMMQKSGEESVKTSWVPDPVTGYYRPEGQANEIDAAELRKMLLKNRSGSN

SEQ ID NO: 5598 - protein, 98 aa, Solanum phureja
MARSFSNSKILSAFVSDSVSALLSRRGYAAASQGAVSGVAKGGVPRSNVIMQKSGEESVKTSWVPDPVTGYYRPEGQANEIDAAELRKMLLKHRSGSN

SEQ ID NO: 5599 - protein, 98 aa, Solanum melongena
MARSFSNSKIISAFVSNSVSTFLRRRGYAAASQGAVSSVGKGGVPRSNVMMQKSGEESVKTSWVPDPVTGYYRPEGQGNEIDPAELRKMLLKHRSGSN

SEQ ID NO: 5600 - protein, 98 aa, Nicotiana tabacum
MARSFSNTKVLSAFVSDSVSAFLSRRGYAAGSQGVVSGGAKGGVPRSNMMMNKSGEESVKTSWVPDPVTGYYRPEGVANEIDAAELRKMLLKHKPRNN

SEQ ID NO: 5601 - protein, 98 aa, Nicotiana tabacum
MARSFSNSKVLSAVVSDSVSAFLCRRGYAAGSQGALSGGAKGGVPRSNMIMNKSGEESVKTSWVPDPVTGYYRPEGVANEIDAAELRKMLLKHKPRSN

SEQ ID NO: 5602 - protein, 98 aa, Capsicum annuum
MARSFSNSKVVSAVVSDSVCAFLSRRGYAAASQGAVSSVAKGGMPRSNVMMQKGGEETLKTSWVPDPVTGYYRPEGKANEIDAAELRKMLLKHKPTNN

SEQ ID NO: 5603 - protein, 90 aa, Capsicum annuum
ARSFSNSKVVSAVVSDSVCAFLSRRGYAAASQGAVSSVAKGRNAKEQCDDAKRRRGNVEDFMGARSSYRLLQAGGKRRMRLTLLSFGRCC

SEQ ID NO: 5604 - protein, 126 aa, Triticum aestivum
MASALTNVSLSTFAPTARGDVLARPQVAPARVTFPTAYRGSGALSCRAGGPATPPGISDKMSDSIKEAQETCSEDAASGECAAAWDEVEELSAAASHARDKLKDSDPLENYCKENPETDECRTYDS

SEQ ID NO: 5605 - protein, 126 aa, Pseudoroegneria spicata
MASALTNVSLSTFAPTARGDVLARPQVAAARVTFPTAYRGSGALSCRAGGPSTPSGISDKMSDSIKEAQETCSEDAASGECAAAWDEVEELSAAASHARDKLKDSDPLENYCKENPETDECRTYDS

SEQ ID NO: 5606 - protein, 66 aa, Secale cereale
MSESIKEAQEACSEDAASGECAAAWDEVEELSAAASHARDKLKDSDPLENYCKENPETDECRTYDS

SEQ ID NO: 5607 - protein, 127 aa, Secale cereale
MASALTNVSLSTFAPTARGDAVLARPQVAATRVTFPTAYRGSGALSCRAGGPSTPPGISDKMSESIKEAQEACSEDAASGECAAAWDEVEELSAAASHARDKLKDSDPLENYCKENPETDECRTYDS

SEQ ID NO: 5608 - protein, 126 aa, Secale cereale
ASALTNVSLSTFAPTARGDAVLARPQVAAARVTFPTAYRGSGALSCRAGGPSTPPGISDKMSESIKEAQEACSEDAASGECAAAWDEVEELSAAASHARDKLKDSDPLENYCKENPETDECRTYDS

SEQ ID NO: 5609 - protein, 124 aa, Leymus cinereus x Leymus triticoides
MASALTNVSLSTFAPTARGDVLARPQVAARVTFPTAHRGGALSCRAGGPSTPPGISDKMSDSIKEAQETCSEDSASGECAAAWDEVEELSAAASHARDKLKDSDPLENYCKENPETDECRTYDS

SEQ ID NO: 5610 - protein, 129 aa, Hordeum vulgare
MASALTNVSLSTFAPTARGDVLARPQVAAAAAARVTFPTAYRGSGALSCRAGGPSTPSGISDKMSESIKEAQETCSEDAASGECAAAWDEVEELSAAASHARDKLKDSDPLENYCKENPETDECRTYDS

SEQ ID NO: 5611 - protein, 123 aa, Avena sativa
MASALTNVSLSIFTAAARGDVLARPQVAARVTFPTLGGRLVACRGVGPSTPPGISDKVSESIKEAQEACSEDGASGECAAAWDEVEELSAAASHARDKLKDSDPLENYCKENPETDECRTYDS

SEQ ID NO: 5612 - protein, 122 aa, Lolium multiflorum
MASALTNVSLSTFAAAARGDVLARPQGPARVTFPAVSRVVACRAGGPATPPGISDKVSESIKDAQEACSDDSASGECAAAWDEVEELSAAASHARDKLKDSDPLENYCKENPETDECRTYDS

SEQ ID NO: 5613 - protein, 80 aa, Triticum aestivum
MASALTNVRLSTFAPTARSDFLARPQVAPARVTFPTEYRGSGALSCRAGGTATPPEISDNMSDSIQDAQDTCSDDAASGE

SEQ ID NO: 5614 - protein, 127 aa, Brachypodium distachyon
MASALTGVSLSTPATFAAATARGDRPQVAPARVTLRSMVMGRGTVACRAGGPSTPPGISDKMSESIKEAQEACSEDSASGECAAAWDEVEELSAAASHARDKLKESDPLENYCKENPETDECRTYDS

SEQ ID NO: 5615 - protein, 490 aa, Triticum aestivum
MDPNSFKTGGLLLPTIERRCASPPSVIVIGGGISGIAAARVLSNSSFEVTVLESRDRIGGRVHTDYSFGCPIDMGASWLHGVSNENSLAPLISHLGLRLYHTSGDNSVLYDHDLESCSLFDKNGLAVPMETAAKVGVIFEKILKETVKLRDEQEHDMPLEQAISMVLERHPDLKLEGLDDRILQWCVCRLEAWFAADADEISLKNWDQEHVLTGGHGLMVDGYFPVIQALAQGLDIRLNQRVKKIARQQKGVTVTIEDGTQYSADACIITVPLGVLKANVIKFEPELPSWKSSAIADLGVGIENKVAMHFDKAFWPNVQVLGMVGPTPKTCGYFLNLHKATGHPVLVFMAAGRFAQDVEKLSDKEAVELVMCHLRKMIPDATEPTQYLVSRWGSDPNSLGSYSCDLVGKPSDVCERFSAPVESVLYFAGEAASAEHSGAVHGAYSSGMDAAEECRRRLLMSKGVPDLVQVGAAACEEMADVVAPLQICRT

SEQ ID NO: 5616 - protein, 490 aa, Triticum aestivum
MDPNSFKTGGLLLPTIERRCASPPSVIVIGGGISGIAAARVLSNSSFEVTVLESRDRIGGRVHTDYSFGCPIDMGASWLHGVSNENSLAPLISHLGLRLYHTSGDNSVLYDHDLESCSLFDKNGLAVPMETAAKVGVIFEKILKETVKLRDEQEHDMPLEQAISMVLERHPDLKLEGLDDRILQWCVCRLEAWFAADADEISLKNWDQEHVLTGGHGLMVDGYFPVIQALAQGLDIRLNQRVKKIARQQKGVTVTIEDGTQYSADACIITVPLGVLKANIIKFEPELPSWKSSAIADLGVGIENKVAMHFDKAFWPNVQVLGMVGPTPKTCGYFLNLHKATGHPVLVFMAAGRFAQDVEKLSDKEAVELVMCHLRKMIPDATEPSQYLVSRWGSDPNSLGSYSCDLVGKPSDVCERFSAPVESVLYFAGEAASAEHSGAVHGAYSSGMDAAEECRRRLLMRKGVPDLVQVGAAACEEMADVVAPLQICRT

SEQ ID NO: 5617 - protein, 490 aa, Secale cereale
MDSNSFKTGGLLLPTIERRCASPPSVIVIGGGISGIAAARVLSNSSFEVTVLESRDRIGGRVHTDYSFGCPIDMGASWLHGVSNENSLAPLIGHLGLRLYHTSGDNSVLYDHDLESCSLFDKNGLAVPMETAAKVGVIFEKILKETVKLRDEQEHDMPLEQAISMVLERHPDLKLEGLDDRILQWCVCRLEAWFAADADEISLKNWDQEHVLTGGHGLMVDGYLPVIQALAQGLDIRLNQRVKKIAREHKGVTVTIEDGTQYSADACIITVPLGVLKANIIKFEPELPSWKSSAISDLGVGIENKVAMHFDKAFWPNVQVLGMVGPTPKTCGYFLNLHKATGHPVLVFMAAGRFAQDVEKLSDKEAVELVMCHLRKMIPDATEPNKYLVSRWGSDPNSLGSYSCDLVGKPSDVCERFSAPVESVLYFAGEAASAEHSGAVHGAYSSGMDAAEECRRRLLMSKGVPDLVQVGAAACEEMADVVAPLQICRT

SEQ ID NO: 5618 - protein, 490 aa, Secale cereale
MDSNSFKTGGLLLPTIERRCASPPSVIVIGGGISGIAAARVLSNSSFEVTVLESRDRIGGRVHTDYSFGCPIDMGASWLHGVSNENSLAPLIGHLGLRLYHTSGDNSVLYDHDLESCSLFDKNGLAVPMETAAKVGVIFEKILKETVKLRDEQEHDMPLEQAISMVLERHPDLKLEGLDDRILQWCVCRLEAWFAADADEISLKNWDQEHVLTGGHGLMVDGYLPVIQALAQGLDIRLNQRVKKIARQNKGVTVTIEDGTQYSADACIITVPLGVLKANIIKFEPELPSWKSSAISDLGVGIENKVAMHFDKAFWPNVQVLGMVGPTPKTCGYFLNLHKATGHPVLVFMAAGRFAQDVEKLSDKEAVELVMCHLRKMIPDATEPNKYLVSRWGSDPNSLGSYSCDLVGKPSDVCERFSAPVESMLYFAGEAASAEHSGAVHGAYSSGMDAAEECRRRLLMSKGVPDLVQVGAAACEEMADVVAPLQICRT

SEQ ID NO: 5619 - protein, 490 aa, Triticum aestivum
MDPNSFKTGGLLLPTIERRCASPPSVIVIGGGISGIAAARVLSNSSFEVTVLESRDRIGGRVHTDYSFGCPIDMGASWLHGVSNENSLAPLIGHLGLRLYHTSGDNSVLYDHDLESCSLFDKNGLAVPMETAAKVGVIFEKILKETVKLRDEQEHDMPLEQAISMVLERHPDLKLEGLDDRILQWCVCRLEAWFAADADEISLKNWDQEHVLTGGHGLMVDGYLPVIQALAQGLDIRLNQRVKKIARQQKGVTVTIEDGTQYSADACIITVPLGVLKANIIKFEPELPSWKSSAIADLGVGIENKVAMHFDKAFWPNVQVLGMVGPTPKTCGYFLNLHKATGHPVLVFMAAGRFAQDVEKLSDKEAVELVMCHLRKMIPDATEPNKYLVSRWGSDPNSLGSYSCDLVGKPSDVCERFSAPVESVLYFAGEAASAEHSGAVHGAYSSGMEAAEECRRRLLMSKGVPDLVQVAGAACEEMADVVAPLQICRT

SEQ ID NO: 5620 - protein, 489 aa, Hordeum vulgare
MDPSSFKTGGLLLPTIERRCASPPSVIVIGGGISGIAAARVLSNSSFEVTVLESRDRIGGRVHTDYSFGCPIDMGASWLHGVSNENSLAPLIGHLGLRLYHTSGDNSVLYDHDLESCSLFDKNGLAVPMETAAKVGVIFEKILKETVKLRDEQEHDMPLEQAISMVLERHPDLKLQGLDDRILQWCVCRLEAWFAADADEISLKNWDQEHVLTGGHGLMVDGYYPVIQALAQGLDIRLNQRVKKIAHQQKGVTVTIEDGTQYSADACIITVPLGVLKANIIKFEPELPSWKSSAIADLGVGIENKVAMHFDKAFWPNVQVLGMVGPTPKTCGYFLNLHKATGHPVLVFMAAGRFAQDVEKLSDKEAVELVMCHLRKMIPNATEPSQYLVSRWGSDPNSLGSYSCDLVGKPSDVCERFSAPVESVLYFAGEAASAEHSGAVHGAYSSGMDAAEECRRRLLMRKGVPDLVQVGAASEEMADIVAPLQICRT

SEQ ID NO: 5621 - protein, 489 aa, Hordeum vulgare
MDPSSFKTGGLLLPTIERRCASPPSVIVIGGGISGIAAARVLSNSSFEVTVLESRDRIGGRVHTDYSFGCPIDMGASWLHGVSNENSLAPLIGHLGLRLYHTSGDNSVLYDHDLESCSLFDKNGLAVPMETAAKVGVIFEKILKETVKLRDEQEHDMPLEQAISMVLERHPDLKLQGLDDRILQWCICRLEAWFAADADEISLKNWDQEHVLTGGHGLMVDGYYPVIQALAQGLDIRLNQRVKKIAHQQKGVTVTIEDGTQYSADACIITVPLGVLKANIIKFEPELPSWKSSAIADLGVGIENKVAMHFDKAFWPNVQVLGMVGPTPKTCGYFLNLHKATGHPVLVFMAAGRFAQDVEKLSDKEAVELVMCHLRKMIPNATEPSQYLVSRWGSDPNSLGSYSCDLVGKPSDVCERFSAPVESVLYFAGEAASAEHSGAVHGAYSSGMDAAEECRRRLLMRKGVPDLVQVGAASEEMADIVAPLQICRT

SEQ ID NO: 5622 - protein, 295 aa, Secale cereale
MFSLVADGLMVDGYLPVIQALAQGLDIRLNQRVKKIAREHKGVTVTIEDGTQYSADACIITVPLGVLKANIIKFEPELPSWKSSAISDLGVGIENKVAMHFDKAFWPNVQVLGMVGPTPKTCGYFLNLHKATGHPVLVFMAAGRFAQDVEKLSDKEAVELVMCHLRKMIPDATEPNKYLVSRWGSDPNSLGSYSCDLVGKPSDVCERFSAPVESVLYFAGEAASAEHSGAVHGAYSSGMDAAEECRRRLLMSKGVPDLVQVGAAACEEMADVVPLSRFAAPRDDSYIQLRSAMPD

SEQ ID NO: 5623 - protein, 489 aa, Leymus cinereus x Leymus triticoides
  misc_feature (307)..(307): Xaa can be any naturally occurring amino acid
  misc_feature (480)..(480): Xaa can be any naturally occurring amino acid
MDPNSFKTGGLLLPTIERRCASPPSVIVIGGGISGIAAARVLSNSSFEVTVLESRDRIGGRVHTDYSFGCPIDMGASWLHGVSNENSLAPLIGHLGLRLYHTSGDNSVLYDHDLESCSLFDKNGLKVPMETAAKVGVIFEKILKETVKLRDEQEHDMPLEQAISMVLERHPDLKLEGLDDRILQWCVCRLEAWFAADADEISLKNWDQEHVLTGGHGLMVDGYYPVIQALAQGLDIRLNQRVKKIAHQYNRVIVTIEDGTQYSADACIITVPLGVLKANVIKFEPELPSWKSSAIADLGVGIENKVXMHFDKAFWPNVQVLGMVGPTPKTCGYFLNLHKATGHPVLVFMAAGRFAQDVEKLSDKEAVKLVMCHLRKMIPDATEPRQYLVSRWGSDPNSLGSYSCDLVGKPSDVCERFSAPVESVLYFAGEAASAEHSGAVHGAYSSGMDAAEECRRRLLMRKGVPDLVQVAGACEEMADXVAPLQICRT

SEQ ID NO: 5624 - protein, 489 aa, Avena sativa
MDPNSFKTGGLLLPTIERRCASPPSVIVIGGGISGIAAARVLSNSSFEVTVLESRDRIGGRVHTDYSFGCPIDMGASWLHGVSNENSLAPLIGHLGLRLYHTSGDNSVLYDHDLESCSLFDKNGLQVPMETAAKVGEIFEKILQETVKLRDEQEHDMPLQQAISMVLERHPDLKLEGLDDRVMQWCVCRLEAWFAADADEISLKNWDQEHVLTGGHGLMVDGYYPVIQALAQGLDIRLNQRVTKIARQYNGVTVTTEDGTQHSADACIITVPLGVLKANIIKFEPELPTWKSSAIADLGVGIENKVAMHFDKAFWPNVQVLGMVGPTPKTCGYFLNLHKATGNPVLVYMAAGRFAQEVEKLSDKEAVALVMAHLKKMVPEATEPTQYLVSRWGSDPNSLGSYSCDLVGKPADVCERFSAPVDSMLYFAGEAASAEHSGAVHGAYSSGMDAAEECRTRLLMRKGVPDLVQVAAACEEMADVVAPLQICRT

SEQ ID NO: 5625 - protein, 457 aa, Secale cereale
MDSNSFKTGGLLLPTIERRCASPPSVIVIGGGISGIAAARVLSNSSFEVTVLESRDRIGGRVHTDYSFGCPIDMGASWLHGVSNENSLAPLIGHLGLRLYHTSGDNSVLYDHDLESCSLFDKNGLAVPMETAAKVGVIFEKILKETVKLRDEQEHDMPLEQAISMVLERHPDLKLEGLDDRILQWCVCRLEAWFAADADEISLKNWDQEHVLTGGHGLMVDGYLPVIQALAQGLDIRLNQRVKKIARQNKGVTVTIEDGTQYSADACIITVPLGVLKANIIKFEPELPSWKSSAISDLGVGIENKVAMHFDKAFWPNVQVLGMVGPTPKTCGYFLNLHKATGHPVLVFMAAGRFAQDVEKLSDKEAVELVMCHLRKMIPDATEPNKYLVSRWGSDPNSLGSYSCDLVGKPSDVCERFSAPVESMLYFAGEAASAEHSGAVHGAYSSGMDAAEECRRR

SEQ ID NO: 5626 - protein, 491 aa, Brachypodium distachyon
MDPNSFMTGGLLLPTIERRCASPPSVIVIGGGISGIAAARVLSNSSFEVTVLESRDRIGGRVHTDYSFGCPIDMGASWLHGVSNENSLAPLIGHLGLRLYQTSGDNSVLYDHDLESCSLFDKNGVQVPRETAAKVGKVFERILEETVKLRDEQEHDMPLQQAISIVLERHPHLKLQGLDDRVLQWCVCRLEAWFAADADEISLKNWDQEHVLTGGHGLMVDGYYPVVQALARGLDIRLNQRVTKVSRQHNRVTVTIEDGTQHCADACIITVPLGVLKANIIKFEPELPLWKSSAIADLGVGIENKVAMHFDRAFWPNVQVLGMVGPTPKTCGYFLNLHKATGNPVLVYMAAGRFAQEVEKLSDKEALDIVMSHLKKMIPAAPEPTQYLVSRWGSDPNSLGSYSCDLVGKPADVCERFSAPVENLYFAGEAASAEHSGAVHGAYSSGLAAAEDCRKRLMLQKGVPDLVQVAACEEVASAAAEVVAPFQICGT

SEQ ID NO: 5627 - protein, 487 aa, Oryza sativa
MDPNSLKTGGLLLPTIERQCASPPSVIVIGGGISGVAAARALSNASFEVTVLESRDRVGGRVHTDYSFGCPIDMGASWLHGVCNENSLAPLIGYLGLKLYRTSGDNSVLYDHDLESYALFDKAGHQVSKETVAKVEETFERILDETVKVRDEQEHDMPLLQAISLVLERHPHLKLQGIDDQVLQWCVCRLEAWFAADADEISLKNWDQEHVLTGGHGLMVNGYYPIIQALAQGLDIRLNQRVTKIARQFNGVTVTTEDGTSYSADACIITVPLGVLKANIIKFEPELPSWKSSAIADLGVGIENKIAMHFDTVFWPNVEVLGMVGPTPKACGYFLNLHKATGNPVLVYMAAGRFAQEVEKLSDKEAVDLVMSHLKKMLPDATEPTKYLVSRWGSDPNSLGSYSCDLVGKPADVSARFAAPVENLYFAGEAASADHSGSVHGAYSSGIAAADECRKRILMQKGIPDLVQVKAYEEMAGVIAPLQICRT

SEQ ID NO: 5628 - protein, 487 aa, Sorghum bicolor
MDPNGLKTGGLLLPTIERRCTSPPSVIVIGGGISGVAAARALSNSSFKVTVLESRDRIGGRVHTDYSFGCPIDMGASWLHGVCNENSLAPLIGYLGLRLYRTSDDNSVLYDHDLESYALFDKDGNQVPKETVDKVGETFERILEETVKVRDEQEHDMPLLQAISIVFERHPHLKLEGLDDQVLQWCVCRLEAWFAADADEISLKNWDQERVLTGGHGLMVNGYYPVIEALAQGLDIRLNQRVTEITRQYNGVKVTTEDGTSYFADACIISVPLGVLKANVIKFEPELPSWKSSAIADLGVGVENKIAMHFDRVFWPNVEVLGMVGPTPKACGYFLNLHKATGNPVLVYMAAGRFAQEVEKLSDKEAVSLVVSHLKKMLPDASEPTQYLVSRWGSDPNSLGSYSCDLVGKPADVCARFSAPVDNLYFAGEAASAEHSGSVHGAYSSGIAAAEECRKRLLTLKGIPDLVQVAAWEEMAGAVAPLQICRT

SEQ ID NO: 5629 - protein, 487 aa, Saccharum officinarum
MDPNGLKTGGLLLPTIERRGTSPPSVIVIGGGISGVAAARTLSNSSFKVTVLESRDRIGGRVHTDYSFGCPIDMGASWLHGVCNENSLAPLIGYLGLRLYRTSDDNSVLYDHDLESYALFDKDGNQVPKETVDKVGETFERILEETVKVRDEQEHDMPLLQAISIVFERHPHLKLEGLDDQVLQWCVCRLEAWFAADADEISLKNWDQERVLTGGHGLMVNGYYPVIEALAQGLDIRLNQRVTEITRQYNGVKVTTEDGTSYFADACIISVPLGVLKANIIKFEPELPSWKTSAIADLGVGVENKIAMHFDNVFWPNVEVLGMVGPMPKACGYFLNLHKATGNPVLVYMAAGRFAQEVEKLSDKEAVSLVVSHLKKMLPDATEPTQYLVSRWGSDPNSLGSYSCDLVGKPADVCARFSAPVENLYFAGEAASAEHSGSVHGAYSSGIAAAEECRKRLLTLKGIPDLVQVAAWEEMAGAVAPLQICRT

SEQ ID NO: 5630 - protein, 487 aa, Panicum virgatum
MDPNGLKTGGLLLPTIERRCTSPPSVIVIGGGISGVAAARALSNSSFKVTVLESRDRIGGRVHTDYSFGCPIDMGASWLHGVCSENSLAPLIGYLGLRLYRTSNDNSVLYDHDLESYALFDKDGNQVPKDTVDKVGETFERILEETVKVRDEQEHDMPLLQAISIVFERHPHLKLEGLDDQVLQWCVCRLEAWFAADADEISLKNWDQERVLTGGHGLMVNGYYPVIEAFARGLDIRLNQRVTKISRQYNGVKVTTEDGTNYFADSCIITVPLGVLKANIIKFEPELPPWKSSAIADLGVGIENKIAMHFDRVFWPNVEVLGMVGPTPKACGYFLNLHKATGNPVLVYMAAGRFAQEVEKLLDKEAVDLVVSHLKKMLPDATEPTQYLVSRWGSDPNSLGSYSCDLVGKPADVCARFSAPVENLYFAGEAASAEHSGSVHGAYSSGLAAAEECRKRLLTQKGVPDLVQVAAWEEVAGVVAPLQICRT

SEQ ID NO: 5631 - protein, 487 aa, Setaria italica
MDPNGLKTGGLLLPTIERRCTTPPSVIVIGGGISGVAAARALSNSSFKVTVLESRDRIGGRVHTDYSFGCPIDMGASWLHGVCNENSLAPLIGYLGLRLYRTSDDNSVLYDHDLESYALFDKDGNQVPKETVDKVGETFERILEETVKVRDEQEHDMPLLQAISIVFERFPELKLEGLEDQVLQWCVCRLEAWFAADADEISLKNWDQERVLTGGHGLMVNGYYPVIEALAQGLDIRLNQRVTKITRQYNGVKVTTEDGTNYFADACIITVPLGVLKANIIKFEPELPPWKSSAIADLGVGIENKIAMHFDRVFWPNVEVLGITGPTPKACGYFLNLHKATGNPVLVYMAAGRFAQEVEKLSDKEAVDLVVSHLKKMLPDATEPTQYLVSRWGSDPNSLGSYSCDLVGKPADVCVRFSAPVENLYFAGEAASADHSGSVHGAYSSGLAAAEDCRKRLLTLKGVPDLVQVAAWEEVAGAVAPLQICRT

SEQ ID NO: 5632 - protein, 487 aa, Pennisetum glaucum
MDPNGLKTGGLLLPTIERRCTSPPSVVVIGGGISGVAAARALSNSSFNVTVLESRDRIGGRVHTDYSFGCPIDMGASWLHGVCNENSLAPLIGYLGLRLYRTSDDNSVLYDHDLESYALFDKDGNQVPKETVDKVGEVFGRILEETVKVRDEQEHDMPLLQAISIVFERHPELKLEGLYDQVLQWCVCRLEAWFAADADEISLKNWDQEHVLTGGHGLMVNGYYPVIEALAQGLDIRLNQRVTKINRQHNGVKVTTEDGTNYFADACIITVPLGVLKANIIKFEPELPPWKSSAIADLGVGIENKIAMHFDSVFWPNVEVLGITGPTPKACGYFLNLHKATGNPVLVYMAAGRFAQEVEKLSDKEAVDLVVSHLKKMLPDATEPTKFLVSRWGSDPNSLGSYSCDLVGKPADVCARFSAPVENLYFAGEAASADHSGSVHGAYSSGLAAAEDCRKRLLTLKGIPDLVQVAAWEELAGVVAPLQICRT

SEQ ID NO: 5633 - protein, 485 aa, Setaria italica
MDPNGLKTGGLLLPTIERRCTTPPSVIVIGGGISGVAAARALSNSSFKVTVLESRDRIGGRVHTDYSFGCPIDMGASWLHGVCNENSLAPLIGYLGLRLYRTSDDNSVLYDHDLESYALFDKDGNQVPKETVDKVGETFERILEETVKVRDEQEHDMPLLQAISIVFERFPELKLEGLEDQVLQWCVCRLEAWFAADADEISLKNWDQERVLTGGHGLMVNGYYPVIEALAQGLDIRLNQRVTKITRQYIKVTTEDGTNYFADACIITVPLGVLKANIIKFEPELPPWKSSAIADLGVGIENKIAMHFDRVFWPNVEVLGITGPTPKACGYFLNLHKATGNPVLVYMAAGRFAQEVEKLSDKEAVDLVVSHLKKMLPDATEPTQYLVSRWGSDPNSLGSYSCDLVGKPADVCVRFSAPVENLYFAGEAASADHSGSVHGAYSSGLAAAEDCRKRLLTLKGVPDLVQVAAWEEVAGAVAPLQICRT

SEQ ID NO: 5634 - protein, 487 aa, Zea mays
MDPNGLKTGGLLLPTIERRCTSPPSVIVIGGGISGVAAARALSNSSFKVTVLESRDRIGGRIHTDNSFGCPIDMGASWLHGVCNENPLAPLISYLGLRLYRTSDDNSVLYDHDLESYALFDKDGNQVPKETVDKVGETFERILEETVKVRDEQEHDMPLLQAISIVFERHPHLKLEGLDDQVLQWCVCRLEAWFAADADEISLKNWDQERVLTGGHGLMVNGYYPVIEALAQGLDIRLNQRVTEITRQHNGVKVTTEDGTSYLADACIISVPLGVLKANVIKFEPELPQWKSSAIADLGVGTENKIAMHFDRVFWPNVEVLGMVGPTPKACGYFLNLHKATGNPVLVYMAAGRFAQEVEKLSDKEAVGLVVSHLKKMLPDATEPTQYLVSRWGSDPNSLGSYSCDLVAKPADVCARFAAPVENLHFAGEAASAEHSGSVHGAYSSGIAAAEECRKRLLALKGIPDLVQVAAWEEMAGAVAPLQICRT

SEQ ID NO: 5635 - protein, 487 aa, Cenchrus ciliaris
MDPNGLKTGGLLLPTIERRCTSPPSVIVIGGGISGVAAARALSNSSFKVTVLESRDRIGGRVHTDYSFGCPIDMGASWLHGVCNENSLAPLIGYLGLRLYRTSDDNSVLYDHDLESYALFDKDGNQVPKETVDKVGETFERILEETVKVRDEQEHDMPLLQAISIVFERHPELKLEGLYDQVLQWCVCRLEAWFAADADEISLKNWDQEHVLTGGHGLMVNGYYPVIEALARGLDIRLNQRVTKITRQYNGVKVTTEDGMNYFADACIITVPLGVLKANIIKFEPELPTWKSSAIADLGVGIENKIAMHFDRVFWPNVEVLGITGPTPKACGYFLNLHKATGNPVLVYMAAGRFAQEVEKLTDKEAVDLVVSHLKKMLPDATEPTKYLVSRWGSDPNSLGSYSCDLVGKPADVCARFSAPVENLYFAGEAASADHSGSVHGAYSSGLAAAEDCRKRLLTLKGIPDLVQVAAWEELAGAMVSLQICRT

SEQ ID NO: 5636 - protein, 408 aa, Secale cereale
MPATDYQGSSSSSHSPFVSFGRSLLSRSRDTPASPAMLPSGGEAEAEAFQRHLAVSLAKLRDGEDFLSVAWIRRLLEAFLLCQEEFRAVVADARRRGGGGALAERLVGEYHERAVKALDVCNAARDGVDQVRRWGRLAGIAASVLLGPGEIHEGQLRRARKALSDLSILLVDDAAAAGGGGGVASFLASHRNRSFGRGSRASPSRASSASSSSSSSSHFRSLSWSVSRTWSASRQLQAIGSGLAAPRAHEAGLAAPVYAMGCLLHLASWALVAAVPCPDRAAALQAHHLPAAPPRGAFAWAPPLLTLQDRLTEEGKRKDRRNSCGLLKEIHALEKCAQRLAEAIDAAPIPLSGEREAAVREAAAELAAVCSAMKDGLEPLERQVREVFHRIVRSRMEGLDSPMPNAAD

SEQ ID NO: 5637 - protein, 408 aa, Hordeum vulgare
MPATDYQGSSSSSHSPFASFGRSLLSRTRDTPASPAMLPSGGEAEAEAFQRRVAVSLAELGDGEGFLSVAWIRRLLEAFLLCQEEFRAVVAEVRRRGGGGAQAERLVGEYHERAVKALDVCNAARDGVDQVRRWGRLAGIAASVLLAPGEIHEGQLRRARKALSDLSILLVDDAAAAGGGGGVASFLASHRNRSFGRGSRASPSRASSASSSSSSSSHFRSLSWSVSRTWSASRQLQAIGSGLAAPRAHEAGLAAPVYAMGCLLHLASWALVAAVPCPDRVAALQAHHLPAAPPRGAFAWAPPLLALQDRLTEEGKRKDRRNSCGLLKEIHALEKCAQRLAEAIDAAPIPLTGEREAAVREAATELAAVCSAMKDGLEPLERQVREVFHRIVRSRMEGLDSPMPNAAD

SEQ ID NO: 5638 - protein, 419 aa, Oryza sativa
MPATDYQGSSSTHSHPSPFSSFGRSLLSLRRDSPAAAAGASPAMASGEEADLEAFQRHVAAHLADLRGGEDELLSIEWIRRLLEAFLLCQEEFRVVVALARRRGALSAAAEKMVGDFYERAVKALDVCNAARDGVDQVRRWERLAGIAASVLLAPGEIHEGQLRRARKALSDLSVLLIDDAAAAAGGGGVASFLSSHRNRSFGRARASPSRSATLASSSSSSSSSSSSSHFRSLSWSVSRNWSAARQLQAIGSGLAAPRAHEGGLVAPVYSMGCLLHLAAWALVAAVPCPDRAAALQAHHLPAAPPRAAFPWAPPLLALQERLTEEGKRKDRRNSCGLLKEIHALEKCTQRLAEAIDAAPVPLSGEREAEVREAAAELAAVCAAMRAGLEPLERQVREVFHRIVRSRMEGLDSPMLNAD

SEQ ID NO: 5639 - protein, 170 aa, Secale cereale
MATDAILETIKPRRSPWLEDLPVTNGGAAKGGKVDLSGMRRRVSSSLSLSLQPLSTSSSAAFRRARSMPSIKALAAAGAVRQWWEWGLGWVMTRKPSFARGLEMSDDEAALLGCHCRGTLRHVFYKARAEVRRLLGRDGRPLGGVAAQDFRYDSVSYAQNFDNGDVDARC

SEQ ID NO: 5640 - protein, 169 aa, Pseudoroegneria spicata
MATDAILETIKPRRSPWLEDLPVTNGGAAKGGKVDLSGMRRRVSSSLSLSLQPLSSSSAAFRRARSMPSIKALAAAGAVRRWWEWGLGWVMTRKPSFARGLEMSEDEAALLGCHCRGTLRHVFYKARAEVRRLLGRDGLPLGGVAAQDFRYDSVSYAQNFDNGDVDARC

SEQ ID NO: 5641 - protein, 172 aa, Hordeum vulgare
MATDAILETIKPRRSPWLEDLPVTNGGGGAAKGAKVDLSGMRRRVSSSLSLSLQPLSSSSSAAFRRARSMPSIKALAAAGAVRQWWEWGLGWVMTRKPSFARGLEMNDEEAAVLGCHCRGTLRHVFYKARAEVRRLLGRDGLPLGGVAAQDFRYDSVSYAQNFDNGDVDARC

SEQ ID NO: 5642 - protein, 531 aa, Triticum aestivum
MAAAAGVWQLVGVAVATLLAAVLVAVALGRQRQRRRRAPLEGIPAPEDGCEVADGAWSAAVDGPTDVIIVGAGVAGSALAYTLGKDGRRVHVIERDLTEPDRIVGELLQPGGYLKLMELGLQDCVDEIDAQRVLGYALFKDGKNTKLSYPLEKFHSDVAGRSFHNGRFIQRMREKAASLPNVQLEQGTVTSLLEENGTVKGVQYKIKSGEELKAYAPLTIVCDGCFSNLRRALCSPKVEVPSCFVGLVLENCELPHANHGHVILANPSPILFYPISSTEVRCLVDVPGQKVPSIASGEMANYLKTVVAPQIPPQIYDSFIAAIDKGSIRTMPNRSMPAAPHPTPGALLMGDAFNMRHPLTGGGMTVALSDIVVLRNLIKPLRNLHDASALCKYLESFYTLRKPVASTINTLAGALYKVFSSSPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 5643 - protein, 328 aa, Raphanus sativus
QPVYKDICILNYSERERERERERDKLSKKMKNDNTNSARSNLVKDNELFHVIHKVPCGDTPYVKAKHAQLIEKNPEMAIVWFWKAINTGDRVDSALKDMAVVMKQLDRSEEAIEAIKSFRPRCSKNSQDSLDNVLIDLYKKCGRMEEQVELLKRKLRQIYQGEAFNGKPTKTARSHGKKFQVTVQQEIARLLGNLGWAYMQQAKYLSAEAVYRKAQMVEPDANKSCNLAMCLIKQGRFEEARPLLDDVFTSRVLGADDCRTRQRADELLSELEASLPRRLDAEMEDVLGNILDDDFVLGLEEMTASNYRSKRLPIFEQISSFRNQLVC

SEQ ID NO: 5644 - protein, 799 aa, Triticum aestivum
KVGRVSQENSVFNLSTRESSLNRELLAPAACLIRQCLKAIGSWLEQIGEVSVKVNEGSQLDNVSDYYEVIGPPIQESDNMLLIGQGGMPQVGNITGKGKMQETSSAPDVQLHTENAIAATLTGGNLLYAHPDSGTDEQQGILSKTGWHHVVSDVSSQETSFHIPLHRMLSLLLREAMKKCSGEDAKTEECSVVRSNEFFSQVLGGCEPHGFASVVMEHPLRVRVFCAQVRAGMWRKNGDAPTLSAEWYRSVQWFEQGLESDLFLLQCCGALSSPEFFVRTIQERFGLSDYTSLDLTQQNEYEPVLIQEMLTLIVQLVKERRFCGCSTADNLKRELIYKLAVGDATHSQIVRSLPRDLSSSEQLQDVLDSVAVYSDPSGKKKGKYVLREAFWKELDLYHPRWSSRELQVAKERYCRFCKVSTLGAQLPQWTNVLSPLRNISKIATSKAVLQIVRAVLFYAVYTDASSVSRAPNNVLVTGLHLLSLALDICESESQISADQYGMDIVQHDDESWVVLSSDEKEAFPILTYSTELVSPETDKLKKDSMLTLLVSLMHKEKNDSTFSGCNIPSLVETLLKRFAKLSKQYMSAVRQLAPQVLPSIPDHASAKQNLGSPDSTGKHQCEAAIMAKMGAEQSKPAESMKSSGNEWHDVPTFEPDAPKSTAVETRPVCSLCQDSDSKSPLCCLIRLQSAMETMMAETVEDGQTPRSVAEFASKVLSHVSSTSSLKLPAVQVLEDKLEAERRGAAALREEIGALKKQAERVDAVIAKTQQEMKEVRKKQAETDQILQLLLRRSQGNPAS

SEQ ID NO: 5645 - protein, 1185 aa, Triticum aestivum
RAVCGTVWGQNGVAYRCRTCESDPTCVICVPCFQNGNHKDHDYSILETGGGCCDCGDATAWKPEGFCSRHKGAEQIKPLTEELASSVGPVLDELLLFWKERICVPHAKADDYCKRVAQELTVSVADMLLRFCACSESLLSFVCQRIHESPGLLDALMRAERILDKKVVIKLHELLLKLIAEPAFKYEFAKVFIQYYPVAFSEVIKGGNDYVLEEYPLIPAFSVQIFTVPALTTRLVREHNLLGTLLECLTALFLSCVGEDGRLQTSKWVNLYDASFRLLEDARYVLRHEEVSMYVASERPDLTSSWVKLLLLVQGMDPQKRVTSIHVEDENENLSAPFVLGHYLGVIQSLLMTGVFSSLGQQESTSVTICSTTIKGIESVENRRLAKVGRVSQENSVFNLSTRESSLNRELLAPAACLIRQCLKAIGSWLEQIGEVSVKVNEGSQLDNVSDYYEVIGPPIQESDNMLLIGQGGMPQVGNITGKGKMQETSSAPDVQLHTENAIAATLTGGNLLYAHPDSGTDEQQGILSKTGWHHVVSDVSSQETSFHIPLHRMLSLLLREAMKKCSGEDAKTEECSVVRSNEFFSQVLGGCEPHGFASVVMEHPLRVRVFCAQVRAGMWRKNGDAPTLSAEWYRSVQWFEQGLESDLFLLQCCGALSSPEFFVRTIQERFGLSDYTSLDLTQQNEYEPVLIQEMLTLIVQLVKEHRFCGCSTADNLKRELIYKLAVGDATHSQIVRSLPRDLSSSEQLQDVLDSVAVYSDPSGKKKGKYVLREAFWKELDLYHPRWSSRELQVAKERYCRFCKVSTLGAQLPQWTNVLSPLRSISKIATSKAVLQIVRAVLFYAVYTDASSVSRAPNNVLVTGLHLLSLALDICESESQISADQYGMDIVQHDDESWVVLSSDEKEAFPILTYSTELVSPETDKLKKDSMLTLLVSLMHKEKNDSTFSGCNIPSLVETLLKRFAKLSKQCMSAVRQLAPQVLPSIPDHASAKQNLGSPDSTGKHQCEAAIMAKMGAEQSKPAESMKSSGNEWHDVPTFEPDAPKSTAVETRPVCSLCQDSDSKSPLCCLIRLQSAMETMMAETVEDGQTPRSVAEFASKVLSHVSSTSSLKLPAVQVLEDKLEAERRGASALREEIGALKKQAERVDAVIAKTQQEMKEVRKKQAETDQILQLLLRRSQGNPTS

SEQ ID NO: 5646 - protein, 1109 aa, Triticum aestivum
IKPLTEELASSVGPVLDELLLFWKERICIPHEKADVCKKRVAEELTIAIADMLLRFCACSDNLLSFVSQRIHESPGLLDALMSAERILHRKIVGKLHELLLKLIAEPAFKYEFAKVFIQYYPVAFSEVIKGGNDYVLEEYPLIPAFSVQIFTVPTLTTRLVREHNLLGTLLECLTALFLSCVGEDGRLQTSKWVNLYDASFRLLEDARYVLRHEEVSMYVASERPDLTSSWVKLLLLVQGMDPQKRLASIHVEDENENLSAPFVLGHYLRIIQNLLMMGAFSSPGQQESTSVTICSGTIKGIERVANQQLAKVGRVSQENSVCNLGTRESSSSSELPSPAACLVRQCLKAIGSWLEQIGEVGMKVNEGSQLVDVADYYEVIGPPIQESDNMVMTGKGGMPHVGNITGKGKMQETSSAPDVQLHSENVIAATLTDHKFLYAHPDSGTDELGILNTTGWHHVVFDVSSQATSFHIPLHRMLSLLLREAMNKCFGEDAKTEECSVVRSNEFFSQVLGGCEPYGFASVVMEHPLRVRVFCAQVRAGMWRKNGDAAILSAEWYRSVQWFEQGLESDLFLLQCCGALSSPEFFVRTIQERFGLSDYTSLDLTEHNEYEPVLIQEMLTLIVQLVKERRFCGRSAADNLKRELIYKLAVGDATHSQIVRSLPRDLLSSEQFQDVLDSVAVYSDPSGNKKGKYVLREAFWKELDLYHPRWSSRELQIAKERYYRFCKVSALGAQLPQWTHIFSPLCSISKIATSKSVLQIVRAVLFYAVYTDASSVSRAPDSVLVTGLHLLSLALDICESGSQISADQYGMDLLQHDDESWVVLSSDAEEAFPILTYSTELVSPESDKLKKDSMLTLLVSLMHKEKNDNTFSGCNIPSLVVSLLKRFAKLSKQCMSAVRQMAPQVLPSIPDHASAKQNLGSPDLTGKRQCKAAIMAKMGEEQSKRAESMKSSGNEGRDVPTFEPDAPKSTAVETRSVCSLCQDSGSKSPLCCLIRLQTAMETMMADTVEDGQTPSSIAEFASKVLSHLSSTSSSKSSAVQVLEDKLEVERRGAAALREEMGALRKQAEKADAVIAKTQQEMEEVRKKQAETDQILQLLLCRSQGNPAS

SEQ ID NO: 5647 - protein, 491 aa, Secale cereale
MLTFIVQLVKERRFCGCSTADNLKRELIYKLAVGDATHSQIVRSLPRDLSSNEQFQDVLDSLAVFSDPSGKKKGKYVLREAFWKELDLYHPRWSSRELQIAKERYYRFCKISALGAQLPQWTHVLSPLRSISKIATSKALLQIVRAVLFYAVYTDASSVSRAPNNVLVTGLHLLSLALDICESESQISADQYRMDLLQHDDESWVVLSTDVEEAFPILTYSTELVSPESDKLKKDSMLTLLVSLMHKEKNHSTFSGCNIPSLVESLLKRFAKLSKQCMSEVRQMAPQVLPSMPDHARPKQNLGSPDSMGKHQCEAATMAKMGAEQSKLAESMKSSGNEGHNVPTFEPDAPRSNAVETRQVCSLCRDSDSKSPVCCLIRLQAAVETMMAETVEDGQAPRSVAEFASKVLSHASSTGSSKSPAVQALEDKLEAERQGAAALREEIDALKKLAEKADAVIVKTQQEMEEVRKKQAETDQILQLLLRRSQGNPAS

SEQ ID NO: 5648 - protein, 1038 aa, Triticum aestivum
ADMLLRFCACSESLLSFVSQRIHESPGLLDALMRAERILDKKVVNKLHELLLKLIAEPAFKYEFAKVFIQYYPVAFSEVIKGGNDYVLEEYPLIPAFSVQIFTVPALTTRLVREHNLLGTLLECLTALFLSCVGEDGRLQTSKWVNLYDASFRLLEDARYVLRHEEVSTYVASERPDLTSSWVKLLLLVQGMDPHKRVTSIPAEGENENLSAPFMLGHYLGIIQNLLLKGALSSPGQQESTNVTACSTATKGMESAKNQRLAKVGRVSHENSVCTLSDSSSEIPSPAACLIRQCLKAIGSWLELTGDLGVKVNEGSQLDNVADYYEVIGPPIQESGNMLLIGQGGMPQVGNITGRGKMQETSSVVTLTGGNLLYAHPHSGTDELGLFSKTGWHHAVFDVSSQETSFHIPLHHMLSLLLREAMKKCFGEDAKTEECSVVQSNEFFSQVLGGCEPYGFASVVMEHPLRVRVFCAQVRAGMWRKNGDAAILSAEWYRSVQWFEQGLESDLFLLQCCGALSSPEFFMRTIQERFGLSDYTSLDLTQQNEYESVLIQDMLTFIVQLVKERRFCGCSIADNLKRELIYKLAVGDATHSQIVRSLPHDLSSSEQFEDVLDSVAVCSDPSGKKKGKYVLREAFWKELDLYHPRWSPRELQIAKERYYRFCKVSALGAQLPQWTHVFSPLRSISKIATSKAVLQIVRAVLFYAVYTDASSVSRAPSNVLVTGLHLLSLALDICEAESQISADQYGMDLLQHDDESWVVLSSDAEEAFPILTYSTELVSPESDKLKKDSMLTLLVSLMHKEKNNSTFSGCNIPSLVESLLKRFAKLSKQCMYEVRQMAPQVLPSIPDHASAKLNLGSPDSTGKCQCEAAIMAKMGAEQSKPAESMKSSGNEGHDVPTIETAVETRPVCSLCQDSDSKSRLCCLIRLQAAMETMMAETVEDGQTPSSIAELASKVLSHVSSTSSLESPAVQVLEDKLEAERRGAAALREEISALKKRAEKADVVIAKTQQEMEEVGKKQAETDQILQFLLRRSQGNPAS

SEQ ID NO: 5649 - protein, 594 aa, Triticum aestivum
LSLMGFASVVMEHPLRVRVFCAQVRAGMWRKNGDAPTLSAEWYRSVQWFEQGLESDLFLLQCCGALSSPEFFVRTIQERFGLSDYTSLDLTQQNEYEPVLIQEMLTLIVQLVKERRFCGCSTADNLKRELIYKLAVGDATHSQIVRSLPRDLSSSEQLQDVLDSVAVYPDPSGKKKGKYVLREAFWKELDLYHPRWSSRELQVAKERYCRFCKVSTLGAQLPQWTNVLSPLRSISKIATSKAVLQIVRAVLFYAVYTDASSVSRAPNNVLVTGLHLLSLALDICESESQISADQYGMDIVQHDDESWVVLSSDAEEAFPILTYSTELVSPESDKLKKDSMLTLLVSLMHKEKNDSTFSGCNIPSLVESLLKRFAKLSKQCMSAVRQMAPQVLPSIPDHASAKQNLGSPDSTGKHQCEAAIMAKMGAEQSKPAESMKSSGNEGHDVPTFEPDAPKSTAVETRPVCSLCQDSDSKSPLCCLIRLQTAMETMMAETVEDGQTPRSVAEFASKVLSHVSSTSSLKSPAVQVLEDKLEAERRGAAALREEISALKKRAEKADVVIAKTQQEMEEVGKKQAETDQILQFLLRRSQGNPAS

SEQ ID NO: 5650 - protein, 1026 aa, Triticum aestivum
EGTPCKSVAEELTTSIADMLLRFCACSESLLSFVCQRIHESPGLLDALMRAERILDKKVVNKLHELLLKLIAEPAFKCEFAKVFIQYYPVAFSEVIKGGNDNVLEEYPLIPAFSVQIFTVPTLTTRLVREHNLLGTLLECLTALFLSCVGEDGRLQTSKWVNLYDASFRLLEDARYVLRHEEVSNYVASERPDLTSSWVKLLLLVQGMDPRKRVTSIHVEDENENLSAPFVLGHYLGIIQNLLMMGAFSSLGQQESTSVTICSSTIKGIERVANQQLAKVGRVSQENSVCNLGTRESSSSSELPSPAACLIRQCLKAIGSWLEQIGEVGVKVNEGSQLDDVADYYEVIGPPIQDSDNMVMTGKGGMPHVGNITGKGKMQETSSAPDVQLHSENVIAATLTDHSFLYAHPDSGTDELGILNTTGWHHVVFDVSSQATSFHIPLHRMLSLLLREAMKKCFGKDAKTEECSVVQSNEFFSQVLGGCEPYGFASVVMEHPLRVRVFCAQVRAGMWRKNGDAAILSAEWYRSVQWFEQGLESDLFLLQCCGALSSPEYFMRTIQERFGLSDYTSLDLTEQNEYESVLIQEMLTFIVQLVKERRFCGRSTADNLKRELIYKLAVGDATHSQIVRSLPRDLSSSEQFQDVLDSVAVCSDPSGKKKGKYVLREAFWKELDLYHPRWSPRELQIAKERYYRFCKVSALGTQLPQWTHVLNPLRSISKIATSKAVLQIVRAVLFYAVYTDASSVSRAPNNVFLTSLHLLSLALDICESESQMSADQYGMDIVQHDDESWVVLSSDAEEAFPILTYSTELVSPESDKLKKDSMLTLLVSLMHKEKNDSTFSGCNIPSLVETLLKRFAKLSKQCMSAVRQMAPQVLPSIPDHASAKQNLGSPDSTGKRQCEAAIMAKMGAEQSKPAESMKSSGNEGHDVPTFEPDAPKSTAVETRPVCSLCQDSDSKSPLCCLIRLQTAMETMMADTVEDGQTPRSVAEFASKLLSHASSIGSSKSPAVQVLEDKLEAEDGVQLLSGK

SEQ ID NO: 5651 - protein, 304 aa, Secale cereale
MQSLVKAQARVRARQVRIGLEGQVTQKKAPEKNPHEDPAREIEERWCGGIGSAEDMQAKVLKKQEAAAKRERAMAYALTHQRQAGSRKLKAADVQGPEADENQWGRNWVERWVAVRPWENRLLEGNAKENVPIGDDKEAEENGDRDVSKPKGKAAVSGIQSNGSSQTKDAKHKKSHSDASGSSSGQSAAVPPAASLGSSKLKPKPSDQTSEEVSPQPTDPAPRSTSNPKERPSAQVIAPTKKRLSLPNNAAAGGAARKGQASSSEKTRSVGSRNMAKGASKSEPKQRQSPGSATPKRVQAQASS

SEQ ID NO: 5652 - protein, 162 aa, Secale cereale
AEKGALLLRCYTNGNIPWILKVPLHAEHTVQTEPLASDTNTQTISSQTELNAKEHQAATVIQSAFRAFLARRALRALKGLVRLQALVRGHAVRKQAAETLQCMQSLVKAQARVRARQVRIGLKVRCPRRRLLKKMPRRIKLEKLRNAGVAVLARRKICKLKY

SEQ ID NO: 5653 - protein, 350 aa, Triticum aestivum
DKVRELTDHVARLAREGTAVNIGRVAFTTSLNLISRTIFSIDLTSLDDMSSSKEFQEVITAIMEGLGTPNLSDFFPVLAPADLQGMRRRLARLFARLHAVFDAEVDQRLHGRDAGQPRKNDFLDVLLDVAAREDGKDLLDRETLRSHFTDLFAAGSDTSSSTVEWAMTELLQNPSSMAMVCDELAQVIGSRRNIEEADISRLPYLQAVIKETFRLHPPAPLLLPRQPETTVKIAGCTIPKGSRVFINVWAIGRDKDVWTEPEKFMPERFLGSAIDFRGVDSELLPFGAGRRICPGMALAIRMVHVMLASLLNQFKWSLPVELERDGIDMEDQFGLTLAKVVPLCIIATPI

SEQ ID NO: 5654 - protein, 219 aa, Triticum aestivum
REDGKDLLDRETLRSHFTDLFAAGSDTSSSTVEWAMTELLQNPSSMAMVCDELAQVIGSRRNIEEADISRLPYLQAVIKETFRLHPPAPLLLPRQPETTVKIAGCTIPKGSRVFINVWAIGRDKDVWIEPEKFMPERFLGSTIDFRGVDFELLPFGAGRRLCPGMALAIRMVHVMLASLLNQFKWSLPVELERDGINMEDQFGLTLAKVVPLCIIATPI

SEQ ID NO: 5655 - protein, 378 aa, Triticum aestivum
AWLPPGPRWRAFRKIMATELFAPHRLDALHHLRSDKVRELTDHVARLAREGTAVFTTSLNLISRTIFSIDLDDHGRSEDFQEVITAMMEGLGTPNVSDFFPVLAPADLQGMRRRLAWIFARLHAVFDAEVDQRLRGRDAGQPRKNDYLDVLLDVAARDEGKDLLDRETLRSQFTDLFVAGSDISSSTVEWAMAELLRNPSSMAKVCDKLAQVIVSRRNIEEADIVRLPYLQAVIKETFRLHPPAPLLLPRQPEMTVKIAGYTIPKGSRVFINVWAIGRDKDVWTEPEKFMPERFLGSAIDFKGVDFELLPFGAGRRICPGMALAIRMVHVMLASLLNQFKWSLPIELERDGIDMQDHFGLTLVKNVPLCIIATPISGK

SEQ ID NO: 5656 - protein, 230 aa, Triticum aestivum
  misc_feature (51)..(51): Xaa can be any naturally occurring amino acid
TSWDVLLDLAGGEDGKDLLDRETVRSHFTDLLLAGSDTSSSTVEWAMTELXKNPSSMSKVCNELAQVISAGRNIEEADIVRLPYLQAIIKETFRLHPPAPLLLPRQPETTVKIAGCTIPKGSRVFINVWAIGRDKDVWTEPEKFMPERFLGSAIDFRGVDSELLPFGAGRRICPGMALAIRMVHVMLASLLNQFKWNLPVELERDGIDMEDQFGLTLAKVVPLCIIATPI

SEQ ID NO: 5657 - protein, 184 aa, Leymus cinereus x Leymus triticoides
  misc_feature (11)..(11): Xaa can be any naturally occurring amino acid
VAAREDGKDLXDRETLRSQFTDLFAAGSDTSSSTVEWAMAELLQNPTSMANVCDELAQVIGSRRNIEEADIVRLPYLQAVIKETFRLHPPAPLLLPRQPEMTVEIAGYTIPKDSRVFINVWAIGQDKDVWAEPQKFMPERFLGLTIDFRGADFELLPFGAGRRICPGKALAIRMVHVMLASLLN

SEQ ID NO: 5658 - protein, 76 aa, Triticum aestivum
GSDTSSSTVEWAMTELLQNPASMSSACNELAEVIGSKRNIEEDDIVRLPYLQAVIKETFRLHPPGRSCCHANPREH

SEQ ID NO: 5659 - protein, 190 aa, Triticum aestivum
STVEWAMTELLQNPSSMTKVCNELAQVIGSGRNIEEADIVRLPYLQAVIKETFRLHPPGPFLLPRKPERTLKIAGYTIPKGSRVFINVWVIGRDKDVWTEPEKFMPERFLGSSIDFRVVDFELLPFGAGRRICPGMTLAIRMVHVMLASLLNQFKWSLPIELERDGIDMQDHFGLTLVKNVPLCIIATPI

SEQ ID NO: 5660 - protein, 146 aa, Triticum aestivum
MQAIIKETFRLHPPAPLLLPRQPEATLKIAGYTIPKGSRIFINVWAIGRDKDVWDEPEKFMPERFLDSTVDFRGADFELLPFGAGRRICPGMTLATRMVHLILASLLHQFKWSLPAEMERDGIDMEDKFGLTLTKVVPLCIAATPV

SEQ ID NO: 5661 - protein, 487 aa, Zea mays
MIGAIFAPSIVYFALLVYYLPESPRWLASDGKISEARVSLQWLRGKKHDVSGEIAAIVEGVDIISDSTVGAARAQSFSGTSASHTWPRSTFYWQLSDPLVDLLGSVHENMSEGGSRRNSFFPVFNSFSFPEHEHMNEHRDGNSDQQTRETYYAGEANNGDGLRASLLSQAASVEVNDTNTSFTSEGSSSYLRRHGTSVLAQEFMASIHDYDIEEEEEEIHGFALPHQSAPRDMESTGRHPFRHQIVRLSETADMKFKWRVLLQPGIRHALCYGMLIQALQQSTGISGLLRCAPEIFEQSGVASLFSDIGLSPHSTSILMSTLNALLILPCITAAMLLMDVCGRRVIVLATTPVLILSLSVMSMSTLVNMGPFESAVLFHFALTICFWSYVIGLGPIPNILCSEIFPTKARATCASFCSLSFWFGGLLSAYCFPVMLSTIGLGGACGIYALVCCAPLFLVYYRIPETKMLNLELIAELFKLSRQEHVQ

SEQ ID NO: 5662 - protein, 308 aa, Sorghum bicolor
MRCMQALVRAQARVRARRVTQHPLLLLPPPTPPASRATLLGAPYVEPALQGHRDVSDDGEVADLLLRQRSRSRSRGRLGRGEDNGGGRSPSGAWDSSSRTLEDARAEGARRHDAAARRERALAYAYAYQQRQCQRQEDEKAGLGFHWLERWMAATQAQQQQQEQEQEHAPDHAKTTHQSATTRTTSYVTAAAAFPNGMSEKTVEMETSFGSPLNHHAATVAHGRPPAIPGYMAATRSARAKARPVPPSATPTHARSRSGGGLAGDSSSSGQNGSAIAGYSPDSSGTGEWTPPRFGVSTRTTNSRVAYT

SEQ ID NO: 5663 - protein, 338 aa, Sorghum bicolor
ARRALRALRGLVRLQALVRGHQVRRQVHLTMRCMQALVRAQARVRARRVTQHPLLLLPPPTPPASRATLLGAPYVEPALQGHRDVSDDGEVADLLLRQRSRSRSRGRLGRGEDNGGGRSPSGAWDSSSRTLEDARAEGARRHDAAARRERALAYAYAYQQRQCQRQEDEKAGLGFHWLERWMAATQAQQQQQEQEQEHAPDHAKTTHQSATTRTTSYVTAAAAFPNGMSEKTVEMETSFGSPLNHHAATVAHGRPPAIPGYMAATRSARAKARPVPPSATPTHARSRSGGGLAGDSSSSGQNGSAIAGYSPDSSGTGEWTPPRFGVSTRTTNSRVAYT

SEQ ID NO: 5664 - protein, 414 aa, Saccharum officinarum
QTETCELLIVDRSIDQIAPIIHEWTYDAMCHDLLCMDGNKYVHEVPSKNGSATEKKEVLLEDHDPVWLELRHAHIADASERLHDKMTNFISKNKAAQLHQARTGGELSTRDLQKMVQALPQYSDQIDKLSLHVEIAGKLNNIIREQCLRDVGQLEQDLVFGDAGTKELINFMRTQLVVSRENKLRLLMIYAALNPEKFESDKGAKLMQLAGLSGDDMIAVNNMRCLCGPDTKKSSVGGFTLKFDVHKKKHAHRKERTGEESAWALSRFYPILEELIEKLSKGELPKDEYNCMNDPSPSAHGPPTSSSARSSPAHSMRSRRTGGTWARPRGSDDGYSSDSVLKHASSDFRKLGQRIFVFVIGGATRSELRAAHKLSSKLKRDIILGSSSLDDPPQFITKLKLMSAEELTLDDLQL

SEQ ID NO: 5665 - protein, 445 aa, Panicum virgatum
MTTLRDLVPTKLAAGVWNCLAKYKMTIPEFPQTETCELLIVDRSIDQIAPIIHEWTYDAMCHDLLCMDGNKYVHEVPSKNGSATEKKEVLLEDHDPVWLELRHAHIADASERLHDKMTHFVSKNKAAQLHQARNGGELSTRDLQKMVQALPQYSDQIDKLSLHVEIAGKLNNIIREQCLRDVGQLEQDLVFGDAGTKEVINFLRTQLGVSRENKLRLLMIYAALNPEKFESDKGAKLMQLAGLSDDDMIAVNNMRCLCGPDTKKSTGGGFTLKFDVHKKKHAHRKERTGEESAWALSRFYPVLEELIEKLSKGELPKDEYNCMNDPSPSAHGLPTSSSLQTSPAHSMRSRRTGGTWARPRGSDDGYSSDSVLKHASSDFKKLGQRIFVFVIGGSTRSELRAAHKLSSKLKREVILGSSSLDDPPQFITKLKLMSADELTLDDLQI

SEQ ID NO: 5666 - protein, 285 aa, Brachypodium distachyon
SVQIAGKLNSIIREQCLRDVGQLEQDLVFGDAGTKELINFLRTQLGVSRENKLRLLMIYAAINPEKFESDKGTKLMQLAGLSADDMIAVNNMRSLCSDTKKPSGGGFTLKFDVHKKKHGYRKERTGEESAWALSRFYPVLEELIEKLSKGELPKDEYNCMNDPSPSFHGLPTTTTSSSARTSPAHSMRSRRTGGSWARPRGSDDGYSSDSVLKHASSDFKKRGQRIFVFVIGGATRSELRAAHKLTSKLKREVILGSSSLDDPPQFITKLKMMSAEELTLDDLQI

SEQ ID NO: 5667 - protein, 498 aa, Avena sativa
GIGGAFCESAEGFNKYNACLNTMATRISTVFASMREFPRVHYRVAKTIDASTMTTLRDMVPTKIAAGVWNYLSKYKTSIPEFPQTETCELLIVDRSVDQIAPIIHEWTYDAMCHDLLFMDGNKYVHEVPSKNGSASEKREVLLEDHDPVWLELRHAHIADASERLHDKMTHFVSKNKAAQLHQARTGGELSTRDLQKMVQALPQYSDQIDKLSLHVEIAGKLNSIIREQCLRDVGQLEQDLVFGDAGTKELINFFRTQLGVSRENKLRLLMIYSAINPDKFESDKGTKLMQLAGLSADDMNAVNNMRYLCADIKKPPGGGFTLKFDVHKKKNGHRKERTGDESAWALSRFYPVLEELIEKLSRGELPKDEYNCMNDPSPSFHGLPTSTSTSARTSPAHSMRSKRTGGSWARPRGSDDGYSSDSVLKHASSDFKKLGQRIFVFVIGGATRSELRAAHKLTSKLKREVILGSSSLDDPPQFITKLKMMSAEELTLDDLQI

SEQ ID NO: 5668 - protein, 407 aa, Saccharum officinarum
SIDQIAPIIHEWTYDAMCHDLLCMDGNKYVQEVASKNGSANEKKEVLLEDHDPVWLELRHAHIADANERLHEKMTSFVSKNKAAQLQQARSGGELSTKQLQKMVQALPQYSDQIDKLTLHVEIAGKLNNIIKEQHLKDVGQLEQDLVFGDAGTKELISFLRTRMDVSRENKLRLLMIYASINPEKFFESEKGAKLMQLAGLSADDMIVVNNMRCLRGPDTKKSSVGAFTLKFDLQKKKPGIRKERIGEESTWMLSRFYPILEDLIEKLSKGELPKDEYHCMNDPSPSFRGIPGSTSAQTSPAHQPAQSMRSRRIGGTWARPRNSDDGYSSDSVLKHASSDLRKLGQRLFIFVIGGATRSELRVAHKLSGKLKREIILGSSSLDDPPQFITKLKMLSTEELSLDDLQI

SEQ ID NO: 5669 - protein, 471 aa, Saccharum officinarum
MNCFAGLLSGKRKASKGKSKGAYANKASGNDCPKVKPVEFMDMAYTVVDDASWCRDTVPASACNSRFVVHAPAELAGHASGHNGDKAAVKKDSSAGVGSSSGYSSDAKSAEPDDGERSSLGRMSPTASPKLMRSCSNIETARSVVPAGSDLPAKSRSYNDLKTLPPGRSTARSGVIDASPTASFRTSCSADRVMLKKRSSRQVLPSRSRKLWWQMFLWSHRNLHRPGANATMPTMLPSPGKEEEGGAAHQHDGYTSDTLGAVTAADAKNKGVAVEADPIPSQWVAFSSPLDRVSAWVNSLGNGSFHAVDEGDATGHFGDGGASRPQPRCSEIVELSTTTAGGKRHPPQAKRRAADEAAQASGIVQTLNSFSPVAHIAGMGLKAVPTIAAFSTLRAVNLSGNMIVQISAGSLPKGLHSLDLSRNKIAIIEGLRELTRLRVLNLSYNPDLTDRAWPVELHGDQGAVPGREQDQ

SEQ ID NO: 5670 - protein, 168 aa, Saccharum officinarum
MPWLLVVAVLAGFALGPSAGTDHIVGANHGWNPNINYSLWSGNQTFYVGDLISFRYQKGTHNVFEVNETGYDNCTMAGVAGNWTSGKDFIPLPEARRYYFICGNGFCLQGMKVGITVHPLPHNATSKGSNSRGSTGAQEEAAAAALGARSAAWLATLAVVAAAVAAFC

SEQ ID NO: 5671 - protein, 168 aa, Zea mays
MSWLLVAAVLAGFALGPSAGTDHIVGANHGWNPNINYSLWSGNQTFYVGDLISFRYQKGTHNVFEVNETGYDNCTMAGVAGNWTSGKDFIPLPAARRYYFVCGNGFCLQGMKVAITVHPLPHNATSKGSSSHADTGAQEEAAAAALGTRSAAWLATLAVAAAAVAAFC

SEQ ID NO: 5672 - protein, 166 aa, Setaria italica
MSWLLAVAVLAGFAVDLSAATDHIVGANHGWNPNINYSLWSGNQTFYVGDLISFRYQKGTHNVFEVNETGYDNCTMDGVAGNWTSGKDFIPLPEARRYYFICGNGFCLQGMKVAITVHPLARNASSSNGSSGHGSSGAQGEASAAALGTRSAAWLPALAAAVAAIC

SEQ ID NO: 5673 - protein, 150 aa, Zea mays
MGDGSCCVCKEAPPKYKCPSCRTPYCSVTCFKKHKEESCQKILHQEEISKSALQEEVTLHTTCTAESPNTACPTKALEVEDLSWLVDNNRLRSLAELKGIQDALRDPELQRMILQIDGSSESEKELEKVMEGQAFREFTDKILDIVNPQE

SEQ ID NO: 5674 - protein, 394 aa, Zea mays
MPQAAAAVVHGKDPSTVRPAAALPLKLLRPLLLVAVLGTGFLAAVALLVGGPAYSSALPRPPVALPPAPPSGGGKQPLERWARAPASAWHNMTDDELLWAASWRPSVRRYPYRRTPKVAFMFLTRGPLPLAPLWERFFAGAGGGDAGLFSVYVHATPGYRPDFAPASAFYRRQVPSQVAEWGEPSMFDAERRLLANALLDPGNERFVLLSESCVPLYGFPAVYSYLTRSRESFVGAFDDPGPGGRGRYQGGLAPEVVREQFRKGAQWFELERALAVDVVADGRYYPKFREHCRPPCYADEHYLPTALSILAPARIANRSVTWVDWSRGGAHPATFGEADVGEAFLRRLTAPGKDQGNCTYNGQPAQVCFLFARKLAPGTLQPLLRLAPKLLGYG

SEQ ID NO: 5675 - protein, 505 aa, Secale cereale
MAAGTGRVLPLLAVAAALAAALLYGAPFSKSLGGEGCSLLPHGHFWIASQRVVALGRVGPAAVEVKEGLINAIAVGDYRSFVLRRPLVDYGDAVIMPGLIDVHAHLDEPGREEWEGFSTGTRAAAAGGITTLVDMPLNSYPSTVSEETLKLKVDAARDKLYVDVGFWGGLVPENALNPSKLESLLNAGVLGLKSFMCPSGINDFPMTNSTHIEEGLVTLAKYKRPLLIHAERIPDVASDEKLDGELDPRSYATYLKSRTPAWEESAVRDLKRAMKDTEVGGRSEGAHLHIVHLSDSKTTLELLKDAKHSGAKVTIETCPHYLAFSAEEVPDGDTRFKCSPPIRDAANKENLWEALLDGHIDMLSSDHSPSTPDLKLMEEGNFMKAWGGISSLQFVLPVTWSYGKKYGITLNQLASWWSEKPAELAGQKNKGSLLPGYHADIVVWKPEAQFHLDDTHAVYHKHRNISAYLGKELSGKVLSTFVRGNLVFAEGKHAGAACGATILAK

SEQ ID NO: 5676 - protein, 505 aa, Hordeum vulgare
MAAGKGRVLPLLAVAAALAAALLYTAPFSKSLGGEGCSLLPHGHFWIASQRVVALGRVGPAAVEVKEGLINAIAVGDYRSFVLRRPLVDYGDAVIMPGLIDVHAHLDEPGRAEWEGFSTGTRAAAAGGITTLVDMPLNSFPSTVSEETLKLKVDAARDKLYVDVGFWGGLVPENALNPSKLESLLNAGVLGLKSFMCPSGINDFPMTNSTHIEEGLVTLAKYKRPLLIHAERIPDVASDEELDGELDPRSYATYLKSRTPAWEESAVRDLKRAMKDTEVGGRSEGAHLHIVHLSDSKTSLRLLKDAKHSGAKVTIETCPHYLAFSAEEVPDGDTRFKCSPPIRDAANKENLWEALLDGHIDMLSSDHSPSTPDLKLMEEGNFMKAWGGISSLQFVLPVTWSHGKKYGITLNQLASWWSEKPAELAGQKNKGSILPGYHADIVVWNPEAQFHLDDSHAVYHKHRNISAYLGNELSGKVLSTFVRGNLVFAEGKHAGAACGATILAK

SEQ ID NO: 5677 - protein, 507 aa, Avena sativa
MVASAASGKVLPLLAVAAALAAALLYAAPFSKSLGGEGCSLLPHDHFWIASERVVTLGRVGPAAVEVKGGLINAIAVGDYRSFVLRRPILDYGDAVIMPGLIDVHAHLDEPGRAEWEGFSTGTRAAAAGGITTLVDMPLNSFPSTVSEETLKLKLDAARDKLYVDVGFWGGLVPENAMDPGKLESLLNAGVLGLKSFMCPSGINDFPMTNSTHIEEGLVTLAKYKRPLLIHAERIPDVASDEELDGELDPRSYATYLKSRPATWEESAIRDLKHAMKDTEVGGRSEGAHLHIVHLSDAETTLELLKDAKHSGAKLSIETCPHYLAFSAEEVPDGDTRFKCSPPIRDAANKENLWEALLDGHIDMLSSDHSPSTPDLKLMDEGNFLKAWGGISSLQFVLPITWSHGQKYGITLNQLVSWWSEKPAELAGQKNKGSILPGYHADIVVWKPEARFHLDDSHTVYHKHRNISAYLGTELSGKVLSTFVRGNLVFAEGKHAGAACGVPILAK

SEQ ID NO: 5678 - protein, 506 aa, Setaria italica
MAASAKGRLVPVLAVVAALAAALLYRAPFSKSLGGEGCSLLPHDHFWIASERVVTLGRVGPAAVEVKGGLINAIAVGDYRSFVLRRPLLDYGDAVIMPGLIDVHAHLDEPGREEWEGFSTGTKAAAAGGITTLVDMPLNNFPSTVSEETLKLKLEAARDKLYVDVGFWGGLVPENAFNPSALESLLNAGVLGLKSFMCPSGINDFPMTNSTHIEEGLVTLAKYQRPLLVHAERIPDVEDEDGLDGELDPRSYATYLKSRPPAWEESAIRDLQRAMKDTEAGGRSEGAHIHIVHLSDAKTSLELMKDAKRTGASVTVETCPHYLAFSADEVPDGDTRFKCAPPIRDGMNRENLWKALLDGHIDMLSSDHSPSAPDLKLMEEGNFLKAWGGISSLQFVLPVTWSYGKKYGITLNQLAAWWSENPAKLAGQKNKGAILPGYHADIVVWKPEAQFELDDSHSVYHKHRNISAYLGKELSGKVLSTFVRGNLVFAEDKHAKAACGVQILAK

SEQ ID NO: 5679 - protein, 506 aa, Zea mays
MAASAKGRLVPVLAVAAALAAVLLYRAPFSKSLGGEGCSLLPHDHFWIASDRVVTLGRVGPAAVEVKGGLINAIAVGDYRSFVLRRPLLDYGDAVIMPGLIDVHAHLDEPGRAEWEGFSNGTRAAAAGGITTLVDMPLNSFPSTVSEETLKLKLEAARDKLYVDVGFWGGLVPENAFNPSALEGLLKAGVLGLKSFMCPSGINDFPMTNSTHIEEGLVTLAKYKRSLLIHAERIPEAEDHDLQEDELDPRSYMTYLKSRPPSWEEAAIRDLQRAMKDTELGGRSEGAHIHIVHLSDAKTSLELMKDAKRSGASLSIETCPHYLAFSSEEVPDGDTRFKCSPPIRDDTNRENLWKALLDGHIDMLSSDHSPSTPDLKLMEEGDFLRAWGGISSLQFVLPVTWSYGRKYGVTLNQLASWWSERPAKLAGQKNKGAILPGYHADIVVWKPETEFQLDNNHAIYHKHQNISAYLGKQLSGKVLSTFVRGNLVFAEDKHANAACGVPILAK

SEQ ID NO: 5680 - protein, 506 aa, Sorghum bicolor
MVASAKGRLVSVLAVAAALAAVLLYRAPFSKSLGGEGCSLLPHDHFWVASDRVVTLGRVGPAAVEVKGGLINAIAVGDYRSFVLRRPLLDYGDAVIMPGLIDVHAHLDEPGRAEWEGFSTGTRAAAAGGITTLVDMPLNSFPSTVSEETLKLKLEAAQDKLYVDVGFWGGLVPENAFNPSALEGLLNAGVLGLKSFMCPSGINDFPMTNSTHIEEGLVTLAKYKRPLLIHAERIPEAEDDDMREDELDPRSYMTYLKSRPPSWEESAIRDLHRAMKDTESGGRSEGAHIHIVHLSDAKTSLELMKDAKRSGASLSIETCPHYLAFSSEEVPDGDTRFKCSPPIRDDTNRENLWKALLDGHIDMLSSDHSPSTPDLKLMEEGNFLRAWGGISSLQFVLPVTWSYGRKYGITLNQLSSWWSEKPAKLAGQKNKGAILPGYHADIVVWKPETEFQLDDSHVIYHKHQNISAYLGKQLSGKVLSTFVRGNLVFAEDKHANVACGVPILAK

SEQ ID NO: 5681 - protein, 506 aa, Sorghum bicolor
MVASAKGRLVSVLAVAAALAAVLLYRAPFSKSLGGEGCSLLPHDHFWVASDRVVTLGRVGPAAVEVKGGLINAIAVGDYRSFVLRRPLLDYGDAVIMPGLIDVHAHLDEPGRAEWEGFSTGTRAAAAGGITTLVDMPLNSFPSTVSEETLKLKLEAAQDKLYVDVGFWGGLVPENAFNPSALEGLLNAGVLGLKSFMCPSGINDFPMTNSTHIEEGLVTLAKYKRPLLIHAERIPEAEDDDMREDELDPRSYMTYLKSRPPSWEESAIRDLHRAMKDTESGGRSEGAHIHIVHLSDAKTSLELMKDAKRSGASLSIETCPHYLAFSSEEVPDGDTRFKCSPPIRDDTNRENLWKALLDGHIDMLSSDHSPSTPDLKLMEEGNFLRAWGGISSLQFVLPVTWSYGRKYGITLNQLSSWWSENPAKLAGQKNKGAILPGYHADIVVWKPETEFQLDDSHVIYHKHQNISAYLGKQLSGKVLSTFVRGNLVFAEDKHANVACGVPILAK

SEQ ID NO: 5682 - protein, 475 aa, Pennisetum glaucum
SLGGEGCSLLPHDHFWIASERVVTLGRVGPAAVEVKAGLVNAIAVGDYRSFVLRRPLLDYGDAVIMPGLIDVHAHLDEPGREEWEGFSTGTRAAAAGGITTLVDMPLNSFPSTVSEETLKLKLEAARDKLYVDVGFWGGLVPENAFNPSALESLLNAGVLGLKSFMCPSGINDFPMTNSTHIEQGLVTLAKYKRPLLIHAERIPDVEDDDGLDGELDPRSYATYLKSRPPAWEESAIRDLQRAMKDTEAGGRSEGAHIHIVHLSDAKTSLELMKDAKRTGASVTVETCPHYLAFSAEEVPDGDTRFKCAPPIRDDMNRENLWKALLDGHIDMLSSDHSPSAPDLKLMEEGNFLKAWGGISSLQFVLPVTWSYGKKYGITLNQLATWWSENPAKLAGQKNKGAILPGYHADIVVWKPESQFELDDSHSVYHKHRNISAYLGKELSGKVLSTFVRGNLVFAEDKHAKAACGVQILAK

SEQ ID NO: 5683 - protein, 483 aa, Hordeum vulgare
GCAVADGQGSAAVDGPTDVIIVGAGVAGSALAYTLGKDGRRVHVIERDLTEPDRIVGELLQPGGYLKLMELGLQDCVDEIDAQRVLGYALFKDGKNTKLSYPLEKFHSDVAGRSFHNGRFIQRMREKAASLPNVQLEQGTVTSLLEENGTVKGVQYKIKSGEELKAYAPLTIVCDGCFSNLRRALCSPKVEVPSCFVGLVLENCQLPHANHGHVILANPSPILFYPISSTEVRCLVDVPGQKVPSIASGEMANYLKTVVAPQIPPEIYDSFIAAIDKGSIRTMPNRSMPAAPHPTPGALLMGDAFNMRHPLTGGGMTVALSDIVVLRNLLKPLRNLHDASALCKYLESFYTLRKPVASTINTLAGALYKVFSASPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 5684 - protein, 448 aa, Triticum aestivum
GKDGRRVHVIERDLTEPDRIVGELLQPGGYLKLMELGLQDCVDEIDAQRVLGYALFKDGKNTKLSYPLEKFHSDVAGRSFHNGRFIQRMREKAASLPNVQLEQGTVTSLLEENGTVKGVQYKIKSGEELKAYAPLTIVCDGCFSNLRRALCSPKVEVPSCFVGLVLENCELPHANHGHVILANPSPILFYPISSTEVRCLVDVPGQKVPSIASGEMANYLKTVVAPQIPPQIYDSFIAAIDKGSIRTMPNRSMPAAPHPTPGALLMGDAFNMRHPLTGGGMTVALSDIVVLRNLLKPLRNLHDASALCKYLESFYTLRKPVASTINTLAGALYKVFSSSPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 5685 - protein, 532 aa, Quercus alba
MVAVALDQYALGAIVVSAFALVLAIYSFVAAKKKVAGEARTEAVNCVATATAANGECRSANAADADVIIVGAGVAGSALAHTLGKDGRRVHVIERDLTEPDRIVGELLQPGGYLKLIELGLEDCVNEIDAQRVFGYALFKDGKNTRLSYPLEKFHSDVSGRSFHNGRFIQRMREKSASLPNVRLEQGTVTSLLEENGTVKGVQYKTKDGKEMTAYAPLTVVCDGCFSNLRRSLCNPQVDIPSCFVGLVLENCELPYANHGHVILGDPSPILFYPISSTEVRCLVDVPGQKVPSIANGEMANYLKTVVAPQVPPEIYDSFVAAIDKGNIRTMPNRSMPAAPHPTPGALLMGDAFNMRHPLTGGGMTVALSDIVVLRNLLKPLRDLNDAPTLCKYLESFYTLRKPVASTINTLAGALYKVFCASPDQARKEMREACFDYLSLGGVFSTGPVALLSGLNPRPLSLVLHFFAVAVYGVGRLCLPFPSPSRVWIGARLISGASAIIFPIIKAEGVRQMFFPATVPAYYRAPPVKGDH

SEQ ID NO: 5686 - protein, 230 aa, Amorphophallus konjac
GRRGRKWSAASSKTGSPRAEECGSPAAGDGPADVIVVGAGVAGSALAYALGKDGRRIHVIERDLTEPDRIVGELLQPGGYLKLIELGLQDCVEEIDAQRVFGYALFKDGKNTKLSYPLENFDADVAGRSFHNGRFIQRMREKAASIPNVHLEEGTVTSLIEENGTVKGVSYKTKDGEELKAYAPLTIVCDGCFSNLRRSLCSPKVDIPSCLLVWSSRTANYHTQIMGMSF

SEQ ID NO: 5687 - protein, 358 aa, Papaver somniferum
MREKASTLPNVRLEQGTVTSLLEENGTIKGVLYKTKSGEEINAYAPLTIVCDGCFSNLRRSLCSPKVEVLSCFVGLILENCKLPHQNHGHVILADPSPILFYQISSTEVRCLVDVPGQKVPSIGNGEMAKYLKTMVAPQIPPQIYDSFIAAIDKGSIRTMPNRSMPAAPLPTPGALLMGDAFNMRHPLTGGGMTVALSDIVVLQNLLRPLRNLNDSASLCKYLESFYTLRKPVASTINTLAGALYKVFCASPDRARKEMREACFDYLSLGGVCAEGPIALLSGLNPRPLSLVCHFFAVAIFGVGRLLLPFPSPKRLWIGAKLISTASGIIFPIIRAEGVRQMFFPATVPAYYRSPPVE

SEQ ID NO: 5688 - protein, 537 aa, Malus domestica
MADQYLLGWIFATVLGAVFLCRALARRNGERGRALVEEERSECVKSVMVSNGECRSTDGDVDVIIVGAGVAGAALAHTLGKDGRRVHVIERDLTEPDRIVGELLQPGGYLKLIELGLEDCVEQIDAQRVFGYALFKDGKNTKLSYPLEKFHSDVSGRSFHNGRFIQRMREKAATLPNVLLEQGTVTSLLEEKGTIKGVQYKTKTGEEMTAYAPLTIVCDGCFSNLRRSLCDPKVDVPSCFVGLILENCNLPHANHGHVILADPSPILFYQISSTEVRCLVDVPGQKVPSISNGEMAKYLKTVVAPQIPPQIYDSFIAAVDKGSIRTMPNRSMPAAPYPTPGALLMGDAFNMRHPLTGGGMTVALSDIVVLRNLLRPLGNLNDPSTLSKYLESFYTLRKPVASTINTLAGALYKVFSSSPDQARKEMRQACFDYLSLGGVFSMGPVSLLSGLNPRPLSLVLHFFAVAVYGVGRLLLPFPSPKRAWIGARLISSASGIIFPIIKAEGVRQMFFPATVPAYYRAPVLSEKQMKKTVDGVN

SEQ ID NO: 5689 - protein, 538 aa, Ricinus communis
MEVGTDNYAVIIILGTFFASLFAFVFLSILRYNFKNKNKAKIHDETTLKTQNDNVRLPDNGSGNDVIIVGAGVAGAALAYTLGKDGRRVHVIERDLTEPDRIVGELLQPGGYLKLIELGLEDCVQEIDAQRVLGYALFKDGKNTRLSYPLEKFHADVAGRSFHNGRFIQRMREKAASLPNVKLEQGTVTSLLEENGTIKGVQYKTKDGQEIRAYAPLTIVCDGCFSNLRRSLCNPKVDVPSCFVGLVLENCQLPFANHGHVVLADPSPILFYPISSTEVRCLVDVPGQKVPSIANGEMAKYLKNVVAPQIPPVLHDAFISAIDKGNIRTMPNRSMPADPHPTPGALLMGDAFNMRHPLTGGGMTVALSDIVVLRDLLKPLRDLNDATSLTKYLESFYTLRKPVASTINTLAGALYKVFSASPDQARKEMRQACFDYLSLGGIFSSGPVALLSGLNPRPLSLVMHFFAVAIYGVGRLLLPFPSPKSVWIGARLISSASGIIFPIIKAEGVRQMFFPATIPAIYRPPPVKDTSDDEQKSR

SEQ ID NO: 5690 - protein, 415 aa, Triticum aestivum
MELGLQDCVDEIDAQRVLGYALFKDGKNTKLSYPLEKFHSDVAGRSFHNGRFIQRMREKAASLPNVQLEQGTVTSLLEENGTVKGVQYKIKSGEELKAYAPLTIVCDGCFSNLRRALCSPKVEVPSCFVGLVLENCELPHANHGHVILANPSPILFYPISSTEVRCLVDVPGQKVPSIASGEMTNYLKTVVAPQIPPQIYDSFIAAIDKGSIRTMPNRSMPAAPHPTPGALLMGDAFNMRHPLTGGGMTVALSDIVVLRNLIKPLRNLHDASALCKYLESFYTLRKPVASTINTLAGALYKVFSSSPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 5691 - protein, 536 aa, Prunus persica
MADQYLLGWILASVLGLVALYRTLVKRNDDRRSALVEKRSECVKSVMVSNGECRSTDGDVDVIIVGAGVAGAALAHTLGKDGRRVHVIERDLQEPDRIVGELLQPGGYLKLIELGLEDCVEEIDAQRVFGYALFKDGKNTKLSYPLEKFHSDVSGRSFHNGRFIQRMREKAATLPNVQLEQGTVTSLLEEKGTIKGVQYKDKTGQEMTAYAPLTIVCDGCFSNLRRSLCDPKVDVPSCFVGLILENCDLPHANHGHVILADPSPILFYQISSTEVRCLVDVPGQKVPSISNGEMAKYLKAVVAPQIPPQLYDAFIAAVDKGTIRTMPNRSMPAAPYPTPGALLMGDAFNMRHPLTGGGMTVALSDIVVLQNLLRPLTNLNDASTLSKYLESFYTLRKPVASTINTLAGALYKVFSSSPDQARKEMRQACFDYLSLGGVFSNGPVSLLSGLNPRPLSLVLHFFAVAVYGVGRLLLPFPSPKRAWIGARLISSASGIIFPIIKAEGVRQMFFPATVPAYYRAPVSSEKQMKKTEDSIN

SEQ ID NO: 5692 - protein, 526 aa, Theobroma cacao
MGYECIVEGLVAALLGFVFLYNAFVRGFNKTKAAAGAASSSSSSMVSPMENCVRKTGNGEVAGSTDIIIVGAGVAGSALAYTFGKDGRRVHVIERDLSEPDRIVGELLQPGGYLKLIELDCVDDIDAQQVFGYALYKDGKNTRLSYPLEKFHSDVAGRSFHNGRFIQRMRQKAASLPNVTLEQGTVTSLLEENGTIKGVQYKTKGGQELTAYAPLTIVCDGCFSNLRRSLCDPKVEVPSCFVGLVLENCELPHANYGHVILADPSPILFYPISSTEIRCLVDVPGQKVPSVSNGEMAQYLKTVVAPQIPSELHTAFISAIDKGNIRTMPNRSMPAAPHSTPGALLMGDAFNMRHPLTGGGMTVALSDIVVLRDLLRPLYDLYDASTLCKYLESFYTLRKPVASTINTLAGALYKVFSASPDPARKEMRQACFDYLSLGGVFSNGPISLLSGLNPRPISLVLHFFAVAVYGVGRLLLPFPSPKRIWTGARLISGASGIIFPIIKAEGVRQMFFPATVPAYYRAPPVH

SEQ ID NO: 5693 - protein, 524 aa, Gossypium hirsutum
MADPYVLAWISVFVTTLLALCGVVLKRRKVNGISSSRTMSVTSVSAVDGECRSADGCDTDVIIVGAGVAGSALAHTLGKDGRRVHVIERDLSEPDRIVGELLQPGGYLKLIELGLEDCVEEIDAQQVFGYALFKDGKRTRLSYPLENFHSDVSGRSFHNGRFIQRMREKAASLPNVRLEQGVVTSLLEEKGTIRGVQYKTKDGRELTAFAPLTIVCDGCFSNLRRSLCNPQVDVPSCFVGLVLENCYLPYANHGHVILADPSPILFYPISSTEIRCLVDVPGQKVPSIANGEMANYLKTVVAPQVPPEIYDSFVAAVDKGNIRTMPNRSMPASPYPTPGALLMGDAFNMRHPLTGGGMTVALSDIVVLRDLLKPLRDLNDAPTLCKYLESFYTLRKPVASTINTLAGALYKVFCASPDQARKEMRQACFDYLSLGGVFSTGPISLLSGLNPRPLSLVLHFFAVAIYGVGRLLLPFPSPKRIWIGARLISGASGIIFPIIKAEGVRQMFFPATVPAYYRRAPPAN

SEQ ID NO: 5694 - protein, 524 aa, Gossypium raimondii
MADPYVLAWISVFVTTLLALCGVVLKRRKVIGISSARTESVTSVSAVDGECRSADGCDTDVIIVGAGVAGSALAHTLGKDGRRVHVIERDLSEPDRIVGELLQPGGYLKLIELGLEDCVEEIDAQQVFGYALFKDGKRTRLSYPLENFHSDVSGRSFHNGRFIQRMREKAASLPNVRLEQGVVTSLLEEKGTIRGVQYKTKDGRELTAFAPLTIVCDGCFSNLRRSLCNPQVDVPSCFVGLVLENCYLPYANHGHVILADPSPILFYPISSTEIRCLVDVPGQKVPSIANGEMANYLKTVVAPQVPPEIYDSFVAAVDKGNIRTMPNRSMPASPYPTPGALLMGDAFNMRHPLTGGGMTVALSDIVVLRDLLKPLRDLNDAPTLCKYLESFYTLRKPVASTINTLAGALYKVFCASPDQARKEMRQACFDYLSLGGVFSTGPISLLSGLNPRPLSLVLHFFAVAIYGVGRLLLPFPSPKRIWIGARLISGASGIIFPIIKAEGVRQMFFPATVPAYYRRAPPAN

SEQ ID NO: 5695 - protein, 524 aa, Cannabis sativa
MVDQFVIGWISVSFLSLLAFYNLVLKKNKIPKDSSDKITECIQNDITAINGECRSKDGDVDVIIVGAGVAGSALAHTLGKDGRRVHVIERDLTEPDRIVGELLQPGGYLKLIELGLQDCVEEIDAQRVFGYALFKDGKDTRLSYPLEKFHSDVAGRSFHNGRFIQRMRAKAASLPSVQLEQGTVTTLLEENGIVKGVQYKTKTGQEMAAYAPLTIVCDGCFSNLRRSLCNPKVDVPSCFVGLVLENCNLPYVNHGHVILADPSPILFYQISSTEVRCLVDVPGQKVPSISNGEMAKYLKAVVAPQIPPQIFDSFVAAIDKGNIRTMPNRSMPASPHPTPGALLMGDAFNMRHPLTGGGMTVALSDIVVLRDLLKPLHDLNDSYNLCKYLESFYTLRKPVASTINTLAGALYKVFCASPDQARKEMRNACFDYLSLGGIFSTGPVSLLSGLNPRPLSLVLHFFAVAIFGVGRLLLPFPSPKRMWIGARLVSSASGIIFPIIKAEGVRQMFFPATVPAYYRGPPAK

SEQ ID NO: 5696 - protein, 531 aa, Manihot esculenta
MADHYLLGWILASVAGLFAFYYMVYLVVKREERNNRQDLLQAGSESVKTMSANSGECRSDDDGDFDVIIVGAGVAGSALAHTLGKDGRRVHVIERDLTEPDRIVGELLQPGGYLKLIELGLEDCMEEIDAQRVFGYALFKDGKHTQLAYPLEKFHSDVAGRSFHNGRFIQRMREKAASLPNVRLEQGTVTSLLEEEGTIKGVLYKTKTGEELTAFAPLTIVCDGCFSNLRRSLCNPKVDVPSCFVGLVLENCQLPYANHGHVILADPSPILFYPISSTEVRCLVDVPGQKVPSVSSGEMANYLKTVVAPQVPPEIYNSFVAAVDKGNIRTMPNRSMPAAPYPTPGALLMGDAFNMRHPLTGGGMTVALSDIVVLRDLLKPLRDLHDAPTLCRYLESFYTLRKPVASTINTLAGALYKVFCASPDEARKEMRQACFDYLSLGGVFSTGPVSLLSGLNPRPLSLVLHFFAVAIYAVGRLLLPFPSPRRMWIGARLISGASGIIFPIIKAEGARQMFFPATVPAYYRTPPRKCN

SEQ ID NO: 5697 - protein, 534 aa, Mimulus guttatus
MVDLTLFASLLPFLFGFLFLYYFGFLRKKNQDIRSNSPASAATTTTTTTTAVVGGGECGSRDDVIIVGAGVAGAALAHTLGKEGRRVRVIERDLTEPDRIVGELLQPGGYLKLVELGLEDCVEEIDAQRVFGYALFKDGKATRLSYPLEKFHSDVSGRSFHNGRFIQRMREKASSLPNVCVDQGTVTSLLEENGTIRGVQYKTKSGQELKAYAPLTIVCDGCFSNLRRSLCSPKVEVPSCFVGLVLENCQLPFANHGHVILADPSPILFYPISSTEIRCLVDVPGEKVPSISNGEMAKYLNTVIAPQVPPELHDAFISAIEKGNIRTMPNRSMPAAPHPTPGALLMGDAFNMRHPLTGGGMTVALSDIVVLRNLLKPLNDLGDASALCKYLECFYTLRKPVASTINTLAGALYKVFSASPDEARNEMRQACFDYLSLGGVCSNGPVSLLSGLNPRPLSLVCHFFAVAIFGVGRLLLPFPSPKRMWIGARLISSASGIIFPIIKAEGVRQMFFPATVPAYHRAPPTKDSDVDVQI

SEQ ID NO: 5698 - protein, 538 aa, Malus domestica
MADQYLLGWIFATVLGVVFLYRALAKRSDEKGRGLVEEENRSECVKSVMVSNGECRSTDGDVDVIIVGAGVAGAALAHTLGKDGRRVHVIERDLTEPDRIVGELLQPGGYLKLIELGLEDCVEQIDAQRVFGYALFKDGKNTRLSYPLEKFHSDVSGRSFHNGRFIQRMREKAATLPNVRLEQGTVTSLLEEKGTIKGVQYKTKTGEEMTAYAPLTVVCDGCFSNLRRTLCDPKVDVPSCFVGLVLENCNLPHANHGHVILADPSPILFYKISSTEVRCLVDVPGQKVPSISNGEMAKYLKTAVAPQIPPQIYDSFVAAVDKGTIRTMPNRSMPAAPYPTPGALLMGDAFNMRHPLTGGGMTVALSDIVVLRNLLKPLGNLNDPSTLSKYLESFYTLRKPVASTINTLAGALYKVFSSSPDQARKEMRQACFDYLSLGGVFSTGPVSLLSGLNPRPLSLVLHFFAVAVYGVGRLLLPFPSPKRAWIGARLISSASGIIFPIIKAEGVRQMFFPATVPAYYRAPVSSEKQLKKTEGCVS

SEQ ID NO: 5699 - protein, 524 aa, Aquilegia formosa
MNEYIFGGIIGALLGFFLLYGLSLLTKNKNKKKKNESSIHIQNECNKSSVVDNGDVQSSDIDVIVVGAGVAGAALAYTLGKDGRRVRVIERDLEEPDRIVGELLQPGGYLKLVELGLADCVEKIDAQRVLGYALFKDGKDTKLAYPLEKFHSDVAGRSFHNGRFIQRMREKAASLPNVRLEQGTVTSLLEENGIVKGVLYKANGEEQTAYAPLTIVCDGCFSNLRRSLCSPKVDVPSCFVGLILENCQLPYPNHGHVVLGDPSPILFYPISSSEIRCLVDVPGQKVPSISNGEMANYLKTVVAPQIPHELYDSFLAAIEKGSIRTMPNRSMPAAPHPTPGALLMGDAFNMRHPLTGGGMTVALSDIVVLQNLIKPLRNLHDASALCKYLESFYTLRKPVASTINTLAGALYKVFCASSDQARKEMRQACFDYLSLGGVCSSGPVALLSGLNPRPLSLVCHFFAVAIYGVGRLLLPFPSPKRLWIGAKLISGASGIIFPIIKAEGVRQMFFPATVPAYYRVPPVN

SEQ ID NO: 5700 - protein, 522 aa, Vitis vinifera
MFHPYILGAFFASVLGFLLYALRDKERKDNRHRHHRADGLVTSSSEIGQCRQDDGFGTDIIIVGAGVAGSALAHTLGKDGRRVHIIERDLTEPDRIVGELLQPGGYLKLIELGLEDCVEEIDAQRVLGYALFKDGKNTRLSYPLEKFHSDVAGRSFHNGRFIQRMREKAASLSNVRMEQGTVTSLLEENGTIKGVQYKTKAGQELKAYAPLTIVCDGCFSNLRRSLCNPKVDVPSCFVGLVLENCQLPFANHGHVILADPSPILFYPISSTEVRCLVDVPGQKLPSIANGEMANHLKTRVAPQLPPQLYDAFISAIDQGKIRTMPNRSMPADPYPTPGALLMGDAFNMRHPLTGGGMTVALSDIVVLRDLLKPLSNLNDAVSLSKYLESFYTLRKPVASTINTLAGALYKVFCASPDQARKEMREACFDYLSLGGVCSAGPVALLSGLNPRPLSLVVHFFAVAIYGVGRLLLPFPSLKRLWIGARLISAASSIIFPIIKAEGVRQMFFPVTMPAYYRAPPAK

SEQ ID NO: 5701 - protein, 535 aa, Aquilegia formosa
MNEYIFGGIIGALLGFFLFYSLSLSLLTKKKNKNKNNESCIQIQNECNKSFIVDNGDIQSNDIDVIVVGAGVAGAALAYTLGKDGRRVRVIERDLEEPDRIVGELLQPGGYLKLIELGLADCVEEIDAQKVLGYALFKDGKDTKLAYPLEKFHSDVAGRSFHNGRFIQRMREKAASLPNVRLEQGTVTSLLEENGIVKGVLYKANGEEQTAYAPLTIVCDGCFSNLRRSLCSPKVDVPSCFVGLILENCQLPYPNHGHVVLGDPSPILFYPISGTEIRCLVDVPGQKVPSISNGEMANYLKTVVAPQIPHELYDSFLAAIEKGSIRTMPNRSMPADPHPTPGALLMGDAFNMRHPLTGGGMTVALSDIVVLQNLIKPLRNLHDASALCKYLESFYTLRKPVASTINTLAGALYKVFCASSDQARKEMRQACFDYLSLGGVCSSGPVALLSGLNPRPLSLVCHFFAVAIYGVGRLLLPFPSPKRLWIGAKLISGASGIIFPIIKAEGVRQMFFPATVAAYYRAAPVKEERKKNVCL

SEQ ID NO: 5702 - protein, 524 aa, Gossypium hirsutum
MADPYVLAWISVFVTTLLALCGVVLKRRKVIGISSARTESVTSVSAVDGECRSADGCDTDVIIVGAGVAGSALAHTLGKDGRRVHVIERDLSEPDRIVGELLQPGGYLKLIELGLEDCVEEIDAQQVFGYALFKDGKRTRLSYPLENFHSDVSGRSFHNGRFIQRMRDKAASLPNVRLEQGVVTSLLEEKGTIRGVQYKTKDGRELTAFAPLTIVCDGCFSNLRRSLCNPQVDVPSCFVGLVLENCYLPYANHGHVILADPSPILFYPISSTEIRCLVDVPGQKVPSIANGEMANYLKTVVAPQVPPEIYDSFVAAVDKGNIRTMPNRSMPASPYPTPGALLMGDAFNMRHPLTGGGMTVALSDIVVLHDLLKPLRDLNDAPTLCKYLESFYTLRKPVASTINTLAGALYKVFCASPDQARKEMRQACFDYLSLGGVFSTGPISLLSGLNPRPLSLVLHFFAVAIYGVGRLLLPFPSPKRIWIGARLISGASGIIFPIIKAEGVRQMFFPATVPAYYRRAPPAN

SEQ ID NO: 5703 - protein, 359 aa, Fagus grandifolia
MVDQYTLGGILASVFALVAIYTLVAKKKNNNNRRDSPNARSESVNSVATAKGECRSTNSDADVIIVGAGVAGAALAHTLGKEGRKVHVIERDLTEPDRIVGELLQPGGYLKLIELGLEDCVEKIDAQRVFGYALFKDGKNTRLSYPLEKFHSDVSGRSFHNGRFIQRMREKAATLPNVQLEQGTVTSLLEENGAIKGVQYKTKDGKELTACAPLTIVCDGCFSNLRRTLCDPQVDVPSCFVGLVLENCDLPYANHGHVILADPSPILFYPISSTEVRCLVDVPGQKVPSIANGEMANYLKTVVAPQVPPEIHDSFVAAIDKGNIRTMPNRSMPAAPHPTPGALLMGDAFNMRHPLTGGE

SEQ ID NO: 5704 - protein, 477 aa, Papaver somniferum
SSINGDLRSNGDTDIIIVGAGVAGAALAYTLGKDGRRVVVIERDLTEPDRIVGELLQPGGYLKLIELDLQDCVEQIDSQRVLGYALFKDGKDTRLAYPLEKFHSDVAGRSFHNGRFIQRMREKASTLPNVRLEQGTVTSLLEENGTIKGVLYKTKFGEEINAYAPLTIVCDGCFSNLRRSLCSPKVEVPSCFVGLILENCKLPHQNHGHVILADPSPILFYQISSTEVRCLVDVPGQKVPSIGNGEMAKYLKTMVAPQIPPQIYDSFIAAIDKGSIRTMPNRSMPAAPLPTPGALLMGDAFNMRHPLTGGGMTVALSDIVVLQNLLRPLRNLNDSASLCKYLESFYTLRKPVASTINTLAGALYKVFCASPDQARKEMREACFDYLSLGGVCAEGPVALLSGLNPRPLSLVCHFFAVAIFGVGRLLLPFPSPKRLWIGAKLISTASGIIFPIIRAEGVRQMFFPATVPAYYRSPPVE

SEQ ID NO: 5705 - protein, 524 aa, Citrullus lanatus
MVDQCGLGWILASVLGAAALYFLFGKKNCGVSNERRRESLKNIATTNGECKSSNSDGDIIIVGAGVAGSALAYTLAKDGRRVHVIERDLTEPDRIVGELLQPGGYLKLTELGLEDCVNDIDAQRVYGYALFKDGKDTRLSYPLEKFHSDVSGRSFHNGRFIQRMREKAGSLPNVRLEQGTVTSLLEENGTIKGVQYKNKSGQEMKAYAPLTIVCDGCFSNLRRSLCNPKVDVPSCFVGLVLENCDLPYANHGHVILADPSPILFYPISSTEIRCLVDVPGQKVPSISNGEMANYLKNVVAPQIPPQLYDSFIAAIDKGNIRTMPNRSMPADPYPTPGALLMGDAFNMRHPLTGGGMTVALSDIVVLRDLLKPLRDLNDAPTLCKYLEAFYTLRKPVASTINTLAGALYKVFCASPDQARKEMRQACFDYLSLGGIFSNGPVSLLSGLNPRPLSLVLHFFAVAIYGVGRLLIPFPSPKRVWIGARLISGASAIIFPIIKAEGVRQMFFPKTVAAYYRAPPVVRKR

SEQ ID NO: 5706 - protein, 524 aa, Gossypium hirsutum
MADPYVLAWISVFVTTLLALCGVVLKRRKVIGISSARTESVTSVSAVDGECRSADGCDTDVIIVGAGVAGSALAHTLGKDGRRVHVIERDLSEPDRIVGELLQPGGYLKLIELGLEDCVEEIDAQQVFGYALFKDGKRTRLSYPLENFHSDVSGRSFHNGRFIQRMREKAASLPNVRLEQGVVTSLLEEKGTIRGVQYKTKDGRELTAFAPLTIVCDGCFSNLRRSLCNPQVDVPSCFVGLVLENCHLPYANHGHVILADPSPILFYPISSTEIRCLVDVPGQKVPSIANGEMANYLKTVVAPQVPPEIYDSFVAAVDKGNIRTMPNRSMPASPYPTPGALLMGDAFNMRHPLTGGGMTVALSDIVVLRDLLKPLRDLNDAPTLCKYLESFYTLRKPVASTINTLAGALYEVFCASPDQARKEMRQACFDYLSLGGVFSTGPISLLSGLNPRPLSLVLHFFAVAIYGVGRLLLPFPSPKRIWIGARLISGASGIIFPIIKAEGVRQMFFPATVPAYYRRVPPAN

SEQ ID NO: 5707 - protein, 534 aa, Glycine max
MDYQYILGGIMACSFAFLYVVYSFGAKVTDSSSIHVKSNECAKISSENGICSHEDAGSADIIIVGAGVAGSALACTLGKDGRRVHVIERDLSEPDRIVGELLQPGGYLKLIELGLEDCVDEIDAQQVFGYALYKDGKNTKLSYPLENFGSDISGRSFHNGRFIQRMREKASSLPNVKLEQGTVASLLEEKGTITGVHYKTKSGEEFTAKAPLTIVCDGCFSNLRRSLCNPKVEVPSHFVGLVLENCNLPYANHGHVILGDPSPILFYPISSTEIRCLVDVPGQKLPSLGSGEMARYLKTVVAPQVPPELYDSFIAAVDKGNIRTMPNRSMPASPYPTPGALLMGDAFNMRHPLTGGGMTVALSDIVVLRDLLKPLHDLHDASALCRYLESFYTLRKPVASTINTLAGALYKVFCASPDPARKEMRQACFDYLSLGGVFSDGPIALLSGLNPRPLSLVLHFFAVAIYGVGRLLIPFPSPKRMWIGARLISGASGIIFPIIKAEGVRQMFFPATVPAYYRTPPVHPLNTHEGNTWN

SEQ ID NO: 5708 - protein, 530 aa, Nicotiana tabacum
  misc_feature (323)..(323): Xaa can be any naturally occurring amino acid
MVDMGLSGSVLAVVFGFVAVLWFFIQRNGGRKDKNNDPATATTSTTTTTVYDGECRSKDANDNADIIIVGAGVAGAALAHTLGKEGRRVKVIERDLTEPDRIVGELLQPGGFLKLQELGLEDCVENIDAQRVFGYALFKDGKSTRLSYPLEKFHAEVSGRSFHNGRFIQRMREKAASLPNVKLEQGTVTSLLEENGTIRGVQYKNKSGEELKAYAPLTIVCDGCFSNLRRTLCDPKVEVPSCFVGLVLENCQLPHANHGHVILADPSPILFYPISSTEVRCLVDVPGQKVPSISNGEMGKYLKSIVAPQVPPEIKDAFIAAIXKGNIRTMPNRSMPAAPHPTPGALLMGDAFNMRHPLTGGGMTVALSDIVVLRDLLKPLRDLNDAPTLCRYLESFYTLRKPVASTINTLAGALYKVFCASPDQARKEMRDACFDYLSLGGVFSTGPVSLLSGLNPRPLSLVCHFFAVAIYGVGRLLLPFPSPKRMWIGARLISGASGIIFPIIKAEGVRQMFFPATVPAYYRSPPEVKL

SEQ ID NO: 5709 - protein, 522 aa, Vinca minor
MDQYMVVVATTTFLGFVFLYILLWKTFKNNKEKKHAEGNNNGIRLTVCPPPLTGSTETDVIVVGAGVAGAALAYTLGKDGRRVHVIERDLTEPDRIVGELLQPGGYLKLIELGLEDCVQEIDAQRVLGYALFKDGKSTKLSYPLEKFHSDVAGRSFHNGRFIQRMREKAATLPNVRLEQGTVTSLLEENGTVKGVQYKNKTGEQVQAYAPLTIVCDGCFSNLRRSLCSPKVDVPSCFVGLVLENCQLPFANHGHVVLGDPSPILFYPISSTEIRCLVDVPGQKLPSIANGEMANYLRTKVAPQVPSELHDAFISAIDKGSIRTMPNRSMPAAPLPTPGAILMGDAFNMRHPLTGGGMTVALSDIVVLRDLLKPLRNMNDAESLCKYLESFYTLRKPVAATINTLAGALYMVFCASPDQARKEMRQACFDYLSLGGVCSTGPVALLSGLNPRPLSLVLHFFAVAVYGVGRLLAPFPSPKRLWISARLISGASGIIFPIIKAEGVRQMFFPATVPAYYRAPPAK

SEQ ID NO: 5710 - protein, 306 aa, Eschscholzia californica
EDHCLLLGLFFLYSYSQRKKKERNIDSIEIRNECVKRSINDDDSRSDNGDDFDVIIVGAGVAGSALAHTLGKDGRRVRVIERDLTEPDRIVGELLQPGGYLKLVELGLEDCVEQIDSQRVLGYALFKDGKDTRLAYPLEKFHSDVSGRSFHNGRFIQRMREKAASLPNVRLDQGTVTSLLEENGTVRGVLYKNKAGEEINAYAPLTIVCDGCFSNLRRSLCSPKVEVPSCFVGLVLENCQLPYPNHGHVVLADPSPILFYPISSTEVRCLVDVPGQKVPSIANGEMANYLKTTVAPQIPAQFMIHL

SEQ ID NO: 5711 - protein, 352 aa, Chelidonium majus
MREKAATLPNVKLEQGTVTSLLEENGTIKGVLYKTKDGEETNAYAPLTIVCDGCFSNLRRSLCSPKVEVPSCFVGLILENCQLPYQDHGHVVLADPSPILFYQISSTEVRCLVDVPGQKVPSIANGEMAKYLKTMVAPQIPPQIYDSFVAAIDKGSIRTMPNRSMPAAPLPTPGALLMGDAFNMRHPLTGGGMTVALSDIVVLQNLLKPLRNLNDAPALCRYLESFYTLRKPVASTINTLAGALYKVFCASPDQARKEMRDACFDYLSLGGICSQGPVALLSGLNPRPLSLVCHFFAVAIFGVGRLLLPFPSPKRLWIGARLISGASGIIFPIIKAEGVRQMFFPATVPAYY

SEQ ID NO: 5712 - protein, 541 aa, Fragaria vesca
MVVDQYLLAWIFASVIALIAMYGTVATRRRNNNRRASLEEEERSRGCLMVSDAECRSADGDVDVIIVGAGVAGSALAHTLGKDGRQVRVIERDLTEPDRIVGELLQPGGYLKLIELGLEDCVEEIDAQRVFGYALFKDGKNTRLSYPLEKFHSDVSGRSFHNGRFIQRMRDKAATLPNVQLEQGTVTSLLEEKGTIKGVQYKTKTGQEMTAYAPLTIVCDGCFSNLRRSLCDPKVDVPSCFVGLILENCDLPHANHGHVILADPSPILFYQISSTEVRCLVDVPGQKVPSISNGEMAKYLKTVVAPQIPPQIYDAFVAAVDKGNIRTMPNRSMPAAPYPTPGALLMGDAFNMRHPLTGGGMTVALSDIVVLRDLLRPLCTLNDAPTLSKYLESFYTLRKPVASTINTLAGALYKVFSSSPDQARKEMRQACFDYLSLGGVFSMGPVSLLSGLNPRPLSLVTHFFAVAVYGVGRLLLPFPSPKRLWIGARLISSASGIIFPIIKAEGVRQMFFPATVPAYYRTPVSSEKMRKKDDGRIADDM

SEQ ID NO: 5713 - protein, 531 aa, Theobroma cacao
MVMVFDSYIVGTFLVSLLGFVFLFILRHNNNSRKKKIEKGSRDFKIQTDAVSGTEIGECLPENGSGTDVIIVGAGVAGAALAYTLGKDGRRVHVIERDLTEPDRIVGELLQPGGYLKLVELGLEDCVEEIDAQRVLGYALFKDERNTKLSYPLEKFHADVAGRSFHNGRFIQRMREKASTLPNVRLEQGTVTSLLEENGTIRGVQYKTKDGQELGAYAPLTIVCDGCFSNLRRSLCNPKVDVPSCFVGLVLENCELPFSNHGHVILGDPSPILFYPISSTEVRCLVDVPGQKVPSIANGEMANYLKTMVAPQVPPELRDAFIAAVNKGNIRTMPNRSMPADPHPTPGALLMGDAFNMRHPLTGGGMTVALSDIVVLRDLLRPLHDLHDAACLTKYLESFYTLRKPVASTINTLAGALYKVFSASPDQARKEMRQACFDYLSLGGIFSTGPVALLSGLNPRPLSLVLHFFAVAIYGVGRLLLPFPSLRRMWIGARLISSASGIIFPIIKAEGVRQMFFPATVPALYRAPPVD

SEQ ID NO: 5714 - protein, 524 aa, Solanum tuberosum
MVDLGLSGSLLAVVLGFVAVFCFFIQRNGGCSKSKIDDSATSTTTTTVYSGKSRSKDGNDDVDIIIVGAGVAGAALAHTLGKEGRRVKVIERDLTEPDRIVGELLQPGGYLKLQELGLEDCVEKIDAQRVFGYALFKDGKSTRLSYPLEKFHSDVSGRSFHNGRFIQRMREKAAALPNVKLEQGTVTSLLEENGIIRGVQYKTKSGEELKAYAPLTVVCDGCFSNLRRTLCDPKVEVPSCFVGLVLENCQLPHENHGHVILADPSPILFYPISSTEVRCLVDVPGQKVPSISNGEMAKYLKSVVAPQVPPEIKDAFIAAIDKGNIRTMPNRSMPAAPHPTPGALLMGDAFNMRHPLTGGGMTVALSDIVVLRDLLKPLRDLNDASTLCRYLESFYTLRKPVASTINTLAGALYKVFCASPDQARKEMREACFDYLSLGGVFSDGPVSLLSGLNPRPLSLVCHFFAVAIFGVGRLLLPFPSPKRIWIGARLISSASAIIFPIIKAEGVRQMFFPATVPAYYRKPS

SEQ ID NO: 5715 - protein, 524 aa, Solanum phureja
MVDLGLSGSLLAVVLGFVAVFCFFIQRNGGCSKSKIDDSATSTTTTTVYSGKSRSKDGNDDVDIIIVGAGVAGAALAHTLGKEGRRVQVIERDLTEPDRIVGELLQPGGYLKLQELGLEDCVEKIDAQRVFGYALFKDGKSTRLSYPLEKFHSDVSGRSFHNGRFIQRMREKAAALPNVKLEQGTVTSLLEENGIIRGVQYKTKSGEELKAYAPLTVVCDGCFSNLRRTLCDPKVEVPSCFVGLVLENCQLPHENHGHVILADPSPILFYPISSTEVRCLVDVPGQKVPSISNGEMAKYLKSVVAPQVPPEIKDAFIAAIDKGNIRTMPNRSMPAAPHPTPGALLMGDAFNMRHPLTGGGMTVALSDIVVLRDLLKPLRDLNDASTLCRYLESFYTLRKPVASTINTLAGALYKVFCASPDQARKEMREACFDYLSLGGVFSDGPVSLLSGLNPRPLSLVCHFFAVAIFGVGRLLLPFPSPKRIWIGARLISSASAIIFPIIKAEGVRQMFFPATVPAYYRKPS

SEQ ID NO: 5716 - protein, 520 aa, Solanum lycopersicum
MVDLGLFGSLLVVVLGFVAVFCFFIGRNKSKNDGSATSTTTTTLYNGESRSKDGNEDVDIIIVGAGVAGAALAHTLGKEGRRVKVIERDLTEPDRIVGELLQPGGYLKLQELGLEDCVEKIDAQRVFGYALFKDGKSTRLSYPLEKFHSDVSGRSFHNGRFIQRMREKAAALPNVKLEQGTVTSLLEEKGIIRGVQYKTKSGEELKAYAPLTVVCDGCFSNLRRTLCDPKVEVPSCFVGLVLENCQLPHENHGHVILADPSPILFYPISSTEVRCLVDVPGQKVPSISNGEMAKYLKSVVAPQVPPEIKDAFIAAIDKGNIRTMPNRSMPAAPHPTPGALLMGDAFNMRHPLTGGGMTVALSDIVVLRDLLKPLRDLNDASTLCRYLESFYTLRKPVASTINTLAGALYKVFCASPDQARKEMREACFDYLSLGGVFSEGPVSLLSGLNPRPLSLVCHFFAVAIFGVGRLLLPFPSPKRIWIGARLISSASAIIFPIIKAEGVRQMFFPATVPAYYRKPS

SEQ ID NO: 5717 - protein, 526 aa, Cajanus cajan
MDYQYILGVILAGSLAFVYVVYSFGARKKVKYTDSSSIHVKSNECAKTSENGKCSYEAAGSADIIIVGAGVAGAALAYTLGKDGRRVHVIERDLSEPDRIVGELLQPGGYLKLIELGLQDCVHEIDAQQVFGYALYKDGKNTKLSYPLENFDSDVSGRSFHNGRFIQRMREKASSLPSVKLEQGTVTSLLEDNGIITGVHYKTKSGQEFTAKAPLTIVCDGCFSNLRRSLCNPKVEVPSHFVGLVLENCNLPYANHGHVILGDPSPILFYPISSTEIRCLVDVPGQKLPSLGSGEMARYLKTVVAPQVPLELYASFIAAVDKGNIRTMPNRSMPASPYPTPGALLMGDAFNMRHPLTGGGMTVALSDIVVLRDLLKPLHDLHDASALCRYLESFYTLRKPVASTINTLAGALYKVFCASPDPARKEMRQACFDYLSLGGVFSNGPIALLSGLNPRPLSLVLHFFAVAIYGVGRLLIPFPSPKRMWIGARLISGASGIIFPIIKAEGVRQMFFPATVPAYYRAPPVH

SEQ ID NO: 5718 - protein, 412 aa, Amsonia hubrichtii
MDQYVVVATFFASLFGLLFLYILRPRTVENKQVKHADDHGIQMTVCPLQSGSDTDVIVVGAGVAGAALAYTLGKDGRRVHVIERDLAEPDRIVGELLQPGGYLKLIELGLEDSVEKIDAQRVLGYALFKDGRSTKLSYPLEKFHSDVAGRSFHNGRFIQRMREKAATLPNVRLEQGTVTSLLEENGTVKGVQYKTKAGKELQAYAPLTIVCDGCFSNLRRSLCSPKVDVPSSFVGLVLENCQLPFPNHGHVILGDPSPILFYPISSTEVRCLVDVPGQKLPSIANGEMASYLRTTVAPQVPSELQAAFISAIDKGNIRTMPNRSMPAAPLPTPGALLMGDAFNMRHPLTGGGMTVALSDIVVLRDLLKPLQDMNDAESLCKYLESFYTLRKPVASTINTLAGALLQGFLCFS

SEQ ID NO: 5719 - protein, 520 aa, Aquilegia formosa
MIEYMLGGIIASLLGFLFLYSSSSYLFGKKKKKNVKQEDNECVTSSTKCNLNSNTPDVIIVGAGVAGAALAYTLGKDGRQVHVIERDVTEPDRIVGELLQPGGYLKLVELGLEDCVEEIDAQRVLGYALFKDGKNAKLTYPLTEFHKDVAGRSFHNGRFIQRMREKAATLPNVRLEQGTVTSLLEENGTIKGVSYKTKTGEELQAYAPLTVVCDGCFSNLRRSLCSPKVEVPSCFVGLILENCSLPFPNHGHVVLGDPSPILFYPISSTEVRCLVDVPGQKVPSISNGEMANYLKTVVAPQVPPQLYDSFLAAVEKRSIRTMPNRSMPAAPLPTPGAILMGDAFNMRHPLTGGGMTVALSDIVVLQNLLKPLRDLNDASSLCRYLESFYTLRKPVASTINTLAGALYKVFCASPDQARKEMRQACFDYLSLGGVFSSGPVALLSGLNPRPLSLVCHFFAVAIFGVGRLLMPFPSPKRLWLGARLISGASGIIFPIIKAEGFRQMFFPATVPAYYRAPPTK

SEQ ID NO: 5720 - protein, 524 aa, Cucumis sativus
MVDQCALGWILASVLGASALYLLFGKKNCGVSNERRRESLKNIATTNGECKSSNSDGDIIIVGAGVAGSALAYTLAKDGRQVHVIERDLSEPDRIVGELLQPGGYLKLTELGLEDCVDEIDAQRVYGYALFKDGKDTRLSYPLEKFHSDVSGRSFHNGRFIQRMREKAASLPNVRLEQGTVTSLLEENGTIRGVQYKNKSGQEMTAYAPLTIVCDGCFSNLRRSLCNPKVDVPSCFVGLILENCDLPHANHGHVILADPSPILFYPISSTEIRCLVDVPGQKVPSISNGEMANYLKNVVAPQIPPQLYNSFIAAIDKGNIRTMPNRSMPADPYPTPGALLMGDAFNMRHPLTGGGMTVALSDIVVLRDLLKPLRDLNDAPTLCKYLEAFYTLRKPVASTINTLAGALYKVFCASPDQARKEMRQACFDYLSLGGIFSNGPVSLLSGLNPRPLSLVLHFFAVAIYGVGRLLIPFPSPKRVWIGARLISGASAIIFPIIKAEGVRQMFFPKTVAAYYRAPPIVRER

SEQ ID NO: 5721 - protein, 299 aa, Eschscholzia californica
MIQYILGGTLASLLGFFFLLNVVVYRKKKERKNESIEILDGCVKRSINNDDDLRSEKNEDDFDVIIVGAGVAGAALAHTLGKDGRRVRVIERDLTEPDRIVGELLQPGGYLKLIELGLEDCVEKIDSQKVLGYALFKDGKDTRLAYPLEKFHSDVSGRSFHNGRFIQRMREKAASLPNVRLEQGTVTTLLEENGVIRGVLYKNKAGEEINAYAPLTIVCDGCFSNLRRSLCSPKVDVPSCFVGLVLENCQLPYPNHGHVVLADPSPILFILSVVLRFAVWLTFLGKRYHLLLMAIWPNI

SEQ ID NO: 5722 - protein, 639 aa, Cannabis sativa
MVMVVIKQPHLVFGVRSHFPTQSHPHFHFHSQPFPATHLPKTPLFFLHKSSSTSKDQGPATSLTLLSSIQLIHHHHTTNITLLSPHSPLLSSSSGYRFLLPPKMVPLDPYVFWTFLASFLGFLALCVLRRRNAGVEKNKTTATQTLLSRQEARISGDERDSRAVLGSDTDVLIVGAGVAGSALACTLGKDGRRVRVIERDLTEPDRIVGELLQPGGYLKLVELGLEDCVEEIDAQRILGYALFKDGKNTSLSYPLEKFHADVAGRSFHNGRFIQRMREKAATLPNVQLEQGTVTSLIEEDGTIKGVQYKTKDGEEHKAYAPLTIVCDGCFSNLRRNLCEPKVQVPSCFVGLVLENCQLPYANHGHVILADPSPILFYPISSTEVRCLVDVPGQKVPSVANGEMAKYLKTVVAPQIPPQIQEAFISAVDKGNIRTMPNRSMPANPHPTPGALLLGDAFNMRHPLTGGGMTVALSDIVVLQELLSPLRDLNNADSLCKYLESFYTLRKPVASTINTLADALYKVFSASPDQARKEMRQACFDYLSLGGTCSTGPVALLSGLNPRPLSLVLHFFAVAIYGVGRLLFPFPSPKRMWIGARLISSASGIIFPIIKAEGLRQMFFPATIPAYYRAPPVKGDTESK

SEQ ID NO: 5723 - protein, 522 aa, Vitis vinifera
MFHPYILGAFFASVLGFLLYALRDKERKDNRPRHHRADGLVTSSSEIGQCRQDDGFGTDIIIVGAGVAGSALAHTLGKDGRRVHIIERDLTEPDRIVGELLQPGGYLKLIELGLEDCVEEIDAQRVLGYALFKDGKNTRLSYPLEKFHSDVAGRSFHNGRFIQRMREKAAFLSNVRMEQGTVTSLLEENGTIKGVQYKTKAGQELKAYAPLTIVCDGCFSNLRRSLCNPKVDVPSCFVGLVLENCQLPFANHGHVILADPSPILFYPISSTEVRCLVDVPGQKLPSIANGEMANHLKTRVAPQLPPQLYDAFISAIDQGKIRTMPNRSMPADPYPTPGALLMGDAFNMRHPLTGGGMTVALSDIVVLRDLLKPLSNLNDAVSLSKYLESFYTLRKPVASTINTLAGALYKVFCASTDQARTEMREACFDYLSLGGICSAGPVALLSGLNPRPLSLVVHFFAVAIYGVGRLLLPFPSLKRLWIGARLISAASSIIFPIIKAEGVRQMFFPVTMPAYYRAPPAK

SEQ ID NO: 5724 - protein, 520 aa, Solanum lycopersicum
MVDLGLSGSLLVVVLGFVAVFCFFIGRSKSKNDGSATSTTTTTLYNGESRSKDGNEDVDIIIVGAGVAGAALAHTLGKEGRRVKVIERDLTEPDRIVGELLQPGGYLKLQELGLEDCVEKIDAQRVFGYALFKDGKSTRLSYPLEKFHSDVSGRSFHNGRFIQRMREKAAALPNVKLEQGTVTSLLEEKGIIRGVQYKTKSGEELKAYAPLTVVCDGCFSNLRRTLCDPKVEVPSCFVGLVLENCQLPHENHGHVILADPSPILFYPISSTEVRCLVDVPGQKVPSISNGEMAKYLKSVVAPQVPPEIKDAFIAAIDKGNIRTMPNRSMPAAPHPTPGALLMGDAFNMRHPLTGGGMTVALSDIVVLRDLLKPLRDLNDASTLCRYLESFYTLRKPVASTINTLAGALYKVFCASPDQARKEMREACFDYLSLGGVFSEGPVSLLSGLNPRPLSLVCHFFAVAIFGVGRLLLPFPSPKRIWIGARLISSASAIIFPIIKAEGVRQMFFPATVPAYYRKPS

SEQ ID NO: 5725 - protein, 531 aa, Manihot esculenta
MADHYLLGWILASVLGLFAFYYMVYLVVRREEENNRRAFSEQRSDSVKTIPATNGERRSDDDCHVDVIIVGAGVAGSALAHTLGKDGRRVHVIERDLTEPDRIVGELLQPGGYLKLIELGLEDCVEEIDAQRVFGYALFKDGKHTQLAYPLEKFHSDVAGRSFHNGRFIQRMREKAASLPNVQLEQGTVTSLLEEKGTIKGVLYKTKTGEELTAYAPLTIVCDGCFSNLRRSLCNPKVDVPSCFVGLVLENCQLPYANHGHVILADPSPILFYPISTTEVRCLVDVPGQKVPSISSGEMANYLKNVVAPQVPPEIYSSFVAAVDRGNIRTMPNRSMPASPYPTPGALLMGDAFNMRHPLTGGGMTVALSDIVVLRDLLKPLRDLHDAPTLCRYLESFYTLRKPVASTINTLAGALYKVFSASPDEARKEMRQACFDYLSLGGIFSTGPVSLLSGLNPRPLTLVLHFFAVAIYGVGRLLLPFPSPQRIWIGARLVSGASGIIFPIIKAEGVRQVFFPATVPAYYRAPPIKHN

SEQ ID NO: 5726 - protein, 523 aa, Theobroma cacao
MADSYVWGWILGSVMTLVALCGVVLKRRKGSGISATRTESVKCVSSINGKCRSADGSDADVIIVGAGVAGSALAHTLGKDGRRVHVIERDLTEPDRIVGELLQPGGYLKLIELGLEDCVEEIDAQQVFGYALFKDGKHTRLSYPLEKFHSDVSGRSFHNGRFIQRMREKSASLPNVRLEQGTVTSLLEEKGTIRGVQYKTKDGRELTAFAPLTIVCDGCFSNLRRSLCNPKVDVPSCFVGLVLENCNLPYSNHGHVILADPSPILFYPISSTEVRCLVDVPGQKVPSIANGEMANYLKTIVAPQVPPEIYNSFVAAVDKGNIRTMPNRSMPAAPYPTPGALLMGDAFNMRHPLTGGGMTVALSDIVVLRDLLRPLRDLNDAPTLCKYLESFYTLRKPIASTINTLAGALYKVFCASPDQARKEMRQACFDYLSLGGVFSTGPISLLSGLNPRPVSLVLHFFAVAIYGVGRLLLPFPSPKRIWIGARLISGASGIIFPIIKAEGVRQMFFPATVPAYYRAPPVE

SEQ ID NO: 5727 - protein, 517 aa, Amborella trichopoda
MLQFLFGLALASLIAIALFSGFKKKSPRQNPAVFRPGVRETENGSFQAKDSSTDVIIVGAGVAGSALAYTLGKDGRRVQVIERDLTEPDRIVGELLQPGGYLKLVELGLDDCVHEIDAQRVLGYALFKEGKNTKVSYPLENYNSDVAGRSFHNGRFIQRMREKAASLPQVQLEQGTVTSLIEEKGTVKGVRYKSNGEEHEAYAPLTIVCDGCFSNLRRSLCTPKVEVPSCFVGLVLDLENCHLPYPNHGHVVLADPSPILFYPISSTEIRCLVDVPGQKVPSIANGEMANYLKTVVAPQIPEQLRESFLMAIEKGSIRTMPNKSMPASPYPTPGALLMGDAFNMRHPLTGGGMTVALSDIVVLHNLLKPLRDLHDAPALCKYLESFYTLRKPVASTINTLAGALYKVFCASPDQAMKEMRQACFDYLSLGGVFSTGPVALLSGLNPRPLSLVLHFFAVAVYGVGRLLLPFPSPKRLWLGARLLSGALNIIFPIIKAEGIRQMFFPNTVPAYYRAPPS

SEQ ID NO: 5728 - protein, 522 aa, Euphorbia peplus
MDRRLRNDDILRIYWLYLVVVRKEEEDENNRQAKRNSVTTVSPVTAECRSGDRPHADVIIVGAGVAGAALAFTLGKEGRRVHVIERDLSEPDRIVGELLQPGGYLKLIELELQDCVEEIDAQRVFGYALFKDGKHTQLAYPLEKFHSDVAGRSFHNGRFIQRMREKAASLTNVQLEQGTVTSLLEEQGIIKGVQYKTKNGEELTVFAPLTIVCDGCFSNLRRSLCNPKVDVPSCFVGLVLENCKLPYANHGHVILGDPSPILFYPISSTEVRCLVDVPGQKVPSISNGEMASYLKNVVAPQVPPELHDSFLAAVDKGSIRTMPNRSMPAAPYPTPGALLMGDAFNMRHPLTGGGMTVALSDIVVLRNLLKPLHDLHDAPTLCRYLESFYTLRKPVASTINTLAGALHTVFSASTDEARQEMRQACFDYLTLGGVFSTGPIALLSGLNPRPLSLVLHFFAVAIYGVGRLLLPFPSVKRMWIGARLISGASGIIFPIIKAEGVRQMFFPATVPAYYRAPPVEVN

SEQ ID NO: 5729 - protein, 492 aa, Chelidonium majus
RVQLNENECIKKSCMDNGEFKSESKGETDVIIVGAGVAGAALAYTLGKDGRRVHVIERDLTEPDRIVGELLQPGGYLKLIELGLQDCVEKIDAQRVLGYALIKDGQNTRVSYPLEEFDSDVAGRSFHNGRFIQRMREKAETLPNVRLEQGTVTSLLEENGTIKGVLYKNKSGEELKAYAPLTVVCDGCFSNLRRSLCNPKVDVPSCFVGLILENCKLPHPNHGHVVLADPSPILFYQISSYEVRCLVDVPGQKVPSISNGDMANYLKTVVAPQIPSQLFDSFVAAVDKGNIRTMPNRSMPADPHPTPGALLMGDAFNMRHPLTGGGMTVALSDIVLLHNLLKPLRDLNDASSLCKYLESFYTLRKPVSSTINTLAGALYKVFCASPDQARKEMREACFDYLSLGGVFSSGPVALLSGLNPRPLSLVCHFFAVAIYGVGRLLLPFPSPKRMWMGARLISSASGIIFPIIKAEGVRQMFFPATVPAYYRAPPVK

SEQ ID NO: 5730 - protein, 525 aa, Glycine max
MDYPYILGGIMACSFAFLYVVYSFGAKKVTDSSSIHVKSNECAKTSSEGGICSSDEDAGSADIIIVGAGVAGAALAYTLGKDGRRVHVIERDLSEPDRIVGELLQPGGYLRLIELGLQDCVDEIDSQQVFGYALYMDGKNTKLSYPLEKFSSDISGRSFHNGRFIQRMREKASSLPNVKLEQGTVTSLLEEKGTITGVHYKIKSGQEFTAKAPLTIVCDGCFSNLRRSLCNPKVDVPSHFVGLVLENCNLPYANHGHVILGDPSPVLFYPISSTEIRCLVDVPGQKLPSLGGGEMACYLKTVVAPQVPPELYDSFIAAIDKGNIRTMPNRSMPASPYPTPGALLMGDAFNMRHPLTGGGMTVALSDIVVLRDLLKPLHDLHDASALCRYLESFYTLRKPVASTINTLAGALYKVFCASPDPARKEMRQACFDYLSLGGVFSDGPIALLSGLNPRPLSLVLHFFAVAIYGVGRLLIPFPSPKRMWIGARLISGASGIIFPIIKAEGVRQMFFPATVPAYYRTPPVH

SEQ ID NO: 5731 - protein, 524 aa, Vitis vinifera
MIYQWVLGGIVASLLGFLLLDRSRGKRVKSRAGGHLMEKMKDECVKSSANGECCSGFDGGTDVIVVGAGVAGSALAHTLGKDGRRVHVIERDLSQPDRIVGELLQPGGYLKLIELGLEDCLNEIDAQRVLGYALYKDGKNARLSYPLEQFHSDVAGRSFHNGRFVQRMREKAASLPNVKMEQGTVTSLIEEKGSIKGVQYRTKAGEELKAYAPLTIVCDGCFSNLRRSLCNPKVDVPSCFVGLVLENCQLPHANHGHVILADPSPILFYPISSNEIRCLVDVPGQKVPSIANGEMACYLKTVVAPQIPPELHNAFISAIDKGNVKTMPNRSMPASPYPTPGALLMGDAFNMRHPLTGGGMTVALSDIVVLRDLLKPLQNLNDAAALCKYLEAFYTLRKPVASTINTLAGALYKVFCASPDQARKEMREACFDYLSLGGIFSNGPIALLSGLNPRPLSLVLHFFAVAVYGVGRLLLPFPSPKRMWIGARLISGASGIIFPIIKAEGVRQMFFPATVPAYYRGPPN

SEQ ID NO: 5732 - protein, 207 aa, Capsicum annuum
MADLLTGSILTVVLGLVAVFWFLVWKNSGRRKIEIIDPTTNSTATTTVYDGECRSKDGDDDVDIIVVGAGVAGAALAHTLGKERRRVKVIERDLTEPDRIVGELLQPGGYLKLQELGLEDCVEKIDAQRVFGYALFKDGKSTRLSYPLEKFHSDVSGRSFTMAFHSKNARESCISPQCQARARYCYVCLKKTGPLEVFSTRLNLVKR

SEQ ID NO: 5733 - protein, 524 aa, Phaseolus vulgaris
MDYQYILGGIMVSSFAFLYFVYIFGAKKVTDSSLVHVKSNECEKKSSENGICSHEAAESAEIIIVGAGVAGAALAYTLGKDGRRVHVIERDLSEPDRIVGELLQPGGYLKLIELGLQDCVSEIDAQQVFGYALYKDGKNTKLPYPLEKFSSDVSGRSFHNGRFIQRMREKASSLPNVNLEQGTVTSLLEEKGTITGVQYKTKSGQEFTAKAPLTIVCDGCFSNLRRSLCNPKVEVPSHFVGLILESCDLPYANHGHVILGDPSPILFYPISSTEIRCLVDVPGQKLPSLGNGEMASYLKTVVAPQVPKELYSSFIAAVEKGSIRTMPNRSMPASPQPTPGALLMGDAFNMRHPLTGGGMTVALSDIVVLRDLLKPLRNLHDASALCRYLESFYTLRKPVASTINTLAGALYKVFCASPDPARKEMRQACFDYLSLGGVFSNGPISLLSGLNPRPLSLVLHFFAVAIYGVGRLIIPFPSPKRMWIGARLISSASGIIFPIIKAEGVRQMFFPATVAAYYRAPPVP

SEQ ID NO: 5734 - protein, 536 aa, Gossypium hirsutum
MEMFFDNYIVGTFLVSLFAFLFLFILRRYNNNNNNDNNTRKKRFEKGYSREFKIQTGTGKGECSPGNGSGDEVIIVGAGVAGAALAYTLGKDGRRVHVIERDLTEPDRIVGELLQPGGYLKLVELGLEDCVEDIDAQRVFGYALFKDGRNTKLSYPLEKFQADVSGRSFHNGRLIQRMREKAATLPNVKLEQGTVTSLIEEKGTIIGVQYKTKDGEELRAYAPLTIVCDGCFSNLRRSLCNPKVDVPSCFVGLVLENCELPFSNHGHVILADPSPILFYPISSTEVRCLVDVPGKKVPSVANGEMANHLKTVVAQQVPPELRDAFIAAVDKGNIRTMPNRSMPADPHPTPGALLMGDAFNMRHPLTGGGMTVALSDIVVLRDLLRPLHNLHDAASLTSYLESFYTLRKPVASTINTLAGALYKVFSASPDEARKEMRQACFDYLSLGGVFSTGPVALLSGLNPRPLSLVLHFFAVAIYGVGRLLLPFPSFQRMWIGARLISSASGIIFPIIKAEGVRQMFFPATVPAVYRAPPVVN

SEQ ID NO: 5735 - protein, 522 aa, Musa acuminata
MAEHYLFAAIVASILAFLLLAGIRGRKAARGRKRTDDGAPFAAGKEQCDSDADGCGVPDVIVVGSGVAGSALAYTLGKDGRRVHVIERDLTEPDRIVGELLQPGGYLKLVELGLQDCVEEIDAQRVLGYALFKDGRNTKLAYPLEKFHSDVAGRSFHHGRFIQRMRQKAATLPNVRLEQGTVTSLLEENGTIKGVLYKNKAGEELKAFAPLTIVCDGCFSNLRKSLCSPKVDIPSSFVGLVLENCELPFPNHGHVVLADPSPILFYPISSNEVRCLVDVPGQKVPSVTNGEMASYLKTVVTPQIPAQLHDPFISAIDKGNIRTIANRSMPAVPHPTPGALLMGDAFNMRHPLTGGGMTVALSDIVLLHNLLKPLRDLHDASTLCNYLESFYTLRKPIASTINTLAGALYKVFSASPDRARNEMRQACFDYLSLGGVFSNGPISLLSGLNPRPLTLVAHFFAVAIYGVGRLLLPFPSPKRMWIGARLISGASGIIFPIIKAEGVRQMFFPATVPAYYRKPPAN

SEQ ID NO: 5736 - protein, 523 aa, Vitis vinifera
MVDQGILGWIFASLLGFVVFRSVLLKNKKKGGASVEIRDECVKSTANGECRSKTACEEADVIIVGAGVAGAALANTLGKDGRRVRVIERDLTEPDRIVGELLQPGGYLKLIELGLQDCVEEIDAQRVFGYALFKDGKNTKLSYPLEKFDSDVAGRSFHNGRFIQRMREKAATLPNVQLEQGTVTSLLEEKGTIRGVNYKTKDGETMTAYAPLTIVCDGCFSNLRRSLCTPKVDVPSCFVGLLLEDCELPFANHGHVVLADPSPILFYRISSTEIRCLVDVPGQKVPSISNGEMAKYLKTVVAPQIPPELYDGFIAAINKGNIRTMPNRSMPAAPHPTPGALLMGDAFNMRHPLTGGGMTVALSDIVVLRDLLRPLHDLNDAATLCKYLESFYTLRKPVASTINTLAGALYRVFCASPDQARKEMRDACFDYLSLGGVCSSGPVSLLSGLNPRPLSLVCHFFAVAIFGVGRLLLPFPSPKRVWIGARIISGASGIIFPIIKAEGVRQMFFPATVPAYYRAPPVK

SEQ ID NO: 5737 - protein, 524 aa, Vitis vinifera
MIYQWVLGGIVASLLGFLLLDRSRGKRVKSRAGGYLMEKMKDECVKSSANGECCSGFGGGTDVIVVGAGVAGSALAHTLGKDGRRVHVIERDLSQPDRIVGELLQPGGYLKLIELGLEDCLNEIDAQRVLGYALYKDGKNARLSYPLEQFHSDVAGRSFHNGRFVQRMREKAASIPNVKMEQGTVTSLIEEKGSIKGVQYRTKAGEELKAYAPLTIVCDGCFSNLRRSLCNPKVDVPSCFVGLVLENCQLPHANHGHVILADPSPILFYPISSNEIRCLVDVPGQKVPSIANGEMACYLKTVVAPQIPPELHNAFISAIDKGNVKTMPNRSMPASPYPTPGALLMGDAFNMRHPLTGGGMTVALSDIVVLRDLLKPLQNLNDAAALCKYLEAFYTLRKPVASTINTLAGALYKVFCASPDQARKEMREACFDYLSLGGIFSNGPIALLSGLNPRPLSLVLHFFAVAVYGVGRLLLPFPSPKRMWIGARLISGASGIIFPIIKAEGVRQMFFPATVPAYYRGPPN

SEQ ID NO: 5738 - protein, 536 aa, Gossypium raimondii
MEMVFDNYIVGTFLVSLFAFLFLFILRRYNNNNNNDNNTRKKRFEKGYSREFKIQTGTGKGECSPGNGSGDEVIIVGAGVAGAALAYTLGKDGRRVHVIERDLTEPDRIVGELLQPGGYLKLVELGLEDCVEDIDAQRVFGYALFKDGRNTKLSYPLEKFQADVSGRSFHNGRLIQRMREKAATLPNVKLEQGTVTSLIEEKGTIIGVQYKTKDGEELRAYAPLTIVCDGCFSNLRRSLCNPKVDVPSCFVGLVLENCELPFSNHGHVILADPSPILFYPISSTEVRCLVDVPGKKVPSVANGEMANHLKTVVAQQVPPELRDAFIAAVDKGNIRTMPNRSMPADPHPTPGALLMGDAFNMRHPLTGGGMTVALSDIVVLRDLLRPLHNLHDAASLTSYLESFYTLRKPVASTINTLAGALYKVFSASPDEARKEMRQACFDYLSLGGVFSTGPVALLSGLNPRPLSLVLHFFAVAIYGVGRLLLPFPSFQRMWIGARLIWSASGIIFPIIKAEGVRQMFFPATVPAVYRAPPVVN

SEQ ID NO: 5739 - protein, 520 aa, Citrus sinensis
MDHYIAGTLIAAVFLLLFVVRRNDSKKPRKVSTTYKTQNDVFRSSVNAGKNGSPTDVIIVGAGVAGAALAHTLGKDGRRVHVIERDVTEPDRIVGELLQPGGYLKLVELGLEDCVEEIDAQQVLGYALFKDGKSTRLSYPLEKFHADVSGRSFHNGRFIQRMREKAASLPNVRLEQGTVTSLLEENGTIKGVQYKTKDGQELRAYAPLTIVCDGCFSNLRRSLCKPKVDVPSCFVGLVLENCQLPFANHGHVILADPSPILFYPISSTEVRCLVDVPGQKVPSISNGEMANYLKAMVAPQVPPELHEAFVSAVERGNIRTMPNRSMPADPQPTPGALLMGDAFNMRHPLTGGGMTVALSDIVVLRNLLKPLHDFNDAASLGRYLESFYTLRKPVASTINTLAGALYKVFSSSPDQARKEMRQACFDYLSLGGVFSTGPVALLSGLNPRPLSLVLHFFAVAIYGVGRLLLPFPSPKRMWIGARLISGASGIIFPIIKAEGVRQMFFPATIPAVYRAPPVED

SEQ ID NO: 5740 - protein, 489 aa, Populus trichocarpa
MADQCMPGWILATLFGLSAIYYLVTKKKEQRANKDLLEARSESVNSIATTSGECRSSNVSDVDVIIVGAGVAGAALAHTLGKDGRQVHVIERDLTEPDRIVGEFLQPGGYLKLIELGLEDCVEKIDAQRVFGYALFKDGKHTRLSYPLEKFHSNVAGRSFHNGRFIQRMRDKAASLPNVQLEQGTVISLLEDKGTIRGVQYKTKDGQELKAFAPLTIVCDGCFSNLRRSLCNPKVDVPSCFVGMVLENCQLPCANHAHVILGDPSPILMYPISSTEVRCLVDVPGQKVPSISSGEMAKYLKTVVAPQLPPEVYDAFLAAVDKGNIRTMPNRSMPAAPYPTPGALLMGDAFNMRHPLTGGGMTVALSDIVVLRNLLRPLRNLNDAPTLCKYLESFYTLRKPVASTINTLAGALYKVFCASPDQAMKEMRQACFDYLSLGGVFSAGPVSLLSGLNPRPLSLVAHFFAVAIYGVGRLFCHSLHLNASGLELD

SEQ ID NO: 5741 - protein, 530 aa, Citrullus lanatus
MVDHCAFGWILSAFLAFAIAFSFFLASRRNRRVGGADSTPRTDCVRSSASTNGECRSVDGDADVIIVGAGVAGSALAHTLGKDGRRVHVIERDLTEPDRIVGELLQPGGYLKLIELGLQDCVEEIDAQKVYGYALFKDGKNTRLSYPLENFHSDVSGRSFHNGRFIQRMRKKAASLPNVRLEQGTVTSLLEKKGTIKGVHYKSKNGEEKTAYAPLTIVCDGCFSNLRRSLCNPMVDVPSCFVGLVLENCQLPFANHGHVVLGDPSPILFYPISSTEIRCLVDVPGQKVPSISNGEMEKYLKTVVAPQVPPEIHDAFIAAIEKGNIRTMPNRSMPAAPQPTPGALLMGDAFNMRHPLTGGGMTVALSDIVVLRNLIKPLKDLNDAPTLCKYLESFYTLRMPVASTINTLAGALYKVFCASPDQARKEMRQACFDYLSLGGIFSNGPVSLLSGLNPRPLSLVLHFFAVAIYGVGRLLLPFPSLKGIWIGARLIYSASGIIFPIIKAEGVRQMFFPATVPAYYRTPPVFKPIA

SEQ ID NO: 5742 - protein, 523 aa, Vitis vinifera
MVDQGILGWIFASLLGFVVFRSVLLKNKKKGGASVEIRDECVKSTANGECRSKTACEEADVIIVGAGVAGAALANTLGKDGRRVRVIERDLTEPDRIVGELLQPGGYLKLIELGLQDCVEEIDAQRVFGYALFKDGKNTKLSYPLEKFDSDVAGRSFHNGRFIQRMRERAATLPNVQLEQGTVTSLLEEKGTIRGVNYKTKDGETMTAYAPLTIVCDGCFSNLRRSLCTPKVDVPSCFVGLLLEDCELPFANHGHVVLADPSPILFYRISSTEIRCLVDVPGQKVPSISNGEMAKYLKTVVAPQIPPELYDGFIAAINKGNIRTMPNRSMPAAPHPTPGALLMGDAFNMRHPLTGGGMTVALSDIVVLRDLLRPLHDLNDAATLCKYLESFYTLRKPVASTINTLAGALYRVFCASPDQARKEMRDACFDYLSLGGVCSSGPVSLLSGLNPRPLSLVCHFFAVAIFGVGRLLLPFPSPKRVWIGARIISGASGIIFPIIKAEGVRQMFFPATVPAYYRAPPVK

SEQ ID NO: 5743 - protein, 534 aa, Ricinus communis
MADNYLLGWILCSIIGLFGLYYMVYLVVKREEEDNNRKALLQARSDSAKTMSAVSQNGECRSDNPADADIIIVGAGVAGSALAHTLGKDGRRVHVIERDLTEPDRIVGELLQPGGYLKLIELGLEDCVEEIDAQRVFGYALFMDGKHTQLSYPLEKFHSDVAGRSFHNGRFIQRMREKASSIPNVRLEQGTVTSLIEEKGIIRGVVYKTKTGEELTAFAPLTIVCDGCFSNLRRSLCNPKVDVPSCFVGLVLEDCKLPYQYHGHVVLADPSPILFYQISSTEVRCLVDVPGQKVPSISNGEMAKYLKNVVAPQVPPEIYDSFVAAVDKGNIRTMPNRSMPASPYPTPGALLMGDAFNMRHPLTGGGMTVALSDIVVLRELLKPLRDLHDAPTLCRYLESFYTLRKPVASTINTLAGALYKVFCASSDEARNEMRQACFDYLSLGGVFSTGPISLLSGLNPRPLSLVVHFFAVAIYGVGRLLLPFPSPKRVWVGARLISGASGIIFPIIKAEGVRQMFFPATVPAYYRAPPVECN

SEQ ID NO: 5744 - protein, 525 aa, Cajanus cajan
MVDPYVLGWILCSVLTLFALHSLAFRGTSRRASPENRNDFSETVTTTAGECRSGNRNSDADVIIVGAGVAGAALAYTLGKDGRRVHVIERDLSEPDRIVGELLQPGGYLKLIELGLEDCVDKIDAQQVFGYALFKDGKHTRLSYPLEKFHSDISGRSFHNGRFIQRMREKAASLTNVRLEQGTVTSLVEEKGAIKGVQYKSKDGQALTAYAPLTIVCDGCFSNLRRSLCNPKVDVPSCFVGLVLENCELPCANHGHVILGDPSPILFYPISSTEVRCLVDVPGQKVPSISNGEMEKYLKTTVAPQIPPQLYDSFIAAVDKGNIRTMPNRSMPADPHPTPGALLMGDAFNMRHPLTGGGMTVALSDIVVLRNLLRPLSDLNDAPTLCKYLESFYTLRKPVASTINTLAGALYKVFCASPDQARKEMRQACFDYLSLGGLFSEGPVSLLSGLNPRPLSLVLHFFAVAIFGVGRLLLPFPSPKRVWIGARLISGASAIILPIIKAEGIRQMFFPATVPAYYRSPPVSQ

SEQ ID NO: 5745 - protein, 531 aa, Eucalyptus grandis
MAVDQSVVGWILASLLGLAALCRLVARRGGRRGGGEGRECGVVGTDGIVTTGKQCGSESVNGDGSEADVIIVGAGVAGAALAHTLGKDGRRVHVIERDLTEPDRIVGELLQPGGYLKLIELGLEDCVKEIDAQRVFGYALFKDGQNTRLSYPLEKFHSDVSGRSFHNGRFIQRMREKAATLSNVKLEQGTVTSLIEEKGTIKGVQYKTKDGKELAAYAPLTVVCDGCFSNLRRSLCKPKVDIPSCFVGLILEKCQLPYANHGHVILADPSPILFYPISSTEVRCLVDVPGQKVPNISNGEMANYLKTVVAPQVPHEIHEAFVAAVDKGNIRTMPNRSMPAAPHPTPGALLMGDAFNMRHPLTGGGMTVALSDIVVLRDLLRPLRDLNDAPTLCKYLESFYTLRKPVASTINTLAGALYKVFCASPDPARKEMRQACFDYLSLGGVFSNGPVSLLSGLNPRPLSLVLHFFAVAIYGVGRLMLPFPSIKRMWIGARLISGASGIIFPIIKAEGVRQMFFPAMVPAYYRGPPAK

SEQ ID NO: 5746 - protein, 527 aa, Populus trichocarpa
MTVVIDKHNVLVGTFFAFLFLYILRQNIWKREKIRKRTTLKIQNDSAVSVLRHENGGGFSSADDVIVVGAGVAGAALAYTLGKDGRRVHVIERDMKEPDRIVGELLQPGGYLKLIELGLEDCVEEIDAQRVLGYALFKDGKNTRLSYPLEKFHTDVSGRSFHNGRFIQRMREKAATLPNVRLEQGTVTSLLEEDGTVKGVQYKTKDGQELKAYAPLTIVCDGCFSNLRRSLCNPKVDVPSCFVGLILENCQLPFENHGHVILADPSPILFYPISSTEVRCLVDVPGRKVPSIANGEMANYLKNMVAPQIPSELRNAFISAIDKGNIRTMPNRSMPAEPHPTPGALLMGDAFNMRHPLTGGGMTVALSDIVVLRDLLKPLRDLNDAASLTKYLESFYTLRKPVASTINTLAGALYKVFSASSDDARKEMREACFDYLSLGGNFSAGPVALLSGLNPRPLSLVLHFFAVAVYGVGRLLLPFPSPKRVWIGARLISSASGIIFPIIKAEGVRQMFFPATIPAVYRAPPVD

SEQ ID NO: 5747 - protein, 523 aa, Gossypium hirsutum
MADSYVLGWILCSVMALVALCGVVLRRQKWKGISMRTEPLKTVLTSNGECGSADASHADVIIVGAGVAGSALAHTLGKDGRRVQVIERDLSEPDRIVGELLQPGGYLKLIELGLEDCVEEIDAQQVFGYALFKDGKHTQLSYPLEKFHSDVSGRSFHNGRFIQRMREKSASLPNVHLEQGTVTSLLEEKGIIRGVQYKTKDGRELTAFASLTIVCDGCFSNLRRSLCNPKVDIPSSFVGLVLENCHLPYSNHGHVILADPSPILFYPISSTETRCLVDVPGQKVPSIANGEMANYLKTIVAPQVPPEIYDSFVAAVDKGNIRTMPNRSMPAAPHPTPGALLMGDAFNMRHPLTGGGMTVALSDIVVLRDLLRPLHDLNDAPMLCKYLESFYTLRKPVASTINTLAGALYKVFCASPDQARKEMRQACFDYLSLGGVCSAGPISLLSGLNPRPLSLVLHFFAVAIYSLGRLLLPFPSPKRIWIGARLISGASGIIFPIIKAEGVRQMFFPATVPAYYRAPPTVK

SEQ ID NO: 5748 - protein, 523 aa, Gossypium hirsutum
MADSYVLGWILCSVMALVALCGVVLRRQKWKGISMRTEPLKTVLTSNGECGSADASHADVIIVGAGVAGSALAHTLGKDGRRVQVIERDLSEPDRIVGELLQPGGYLKLIELGLEDCVEEIDAQQVFGYALFKDGKHTQLSYPLEKFHSDVSGRSFHNGRFIQRMREKSASLPNVHLEQGTVTSLLEEKGIIRGVQYKTKDGRELTAFASLTIVCDGCFSNLRRSLCNPKVDIPSSFVGLVLENCHLPYSNHGHVILADPSPILFYPISSTETRCLVDVPGQKVPSIANGEMANYLKTIVAPQVPPEIYDSFVAAVDKGNIRTMPNRSMPAAPHPTPGALLMGDAFNMRHPLTGGGMTVALSDIVVLRDLLRPLHDLNDAPMLCKYLESFYTLRKPVASTINTLAGALYKVFCGSPDQARKEMRQACFDYLSLGGVCSAGPISLLSGLNPRPLSLVLHFFAVAIYSLGRLLLPFPSPKRIWIGARLISGASGIIFPIIKAEGVRQMFFPATVPAYYRAPPTVK

SEQ ID NO: 5749 - protein, 525 aa, Allium cepa
MMMQLSNEYLFGGVIASILGFLFLLKSTNYFNLKKKNIDRTSDNTENVGSKGESGGSCDGPDVVIVGAGVAGAALAYTLGKDGRRVQVIERDLKEPDRIVGELLQPGGYLKLMELGLEDCVEEIDAQRVLGYALFKDGKNTRLSYPLEKFHKDVAGRSFHNGRFIQRMREKAMTLPNVKLEEGTVTSLIEENGAVKGVSYKSKSGEELKAYAPLTIVCDGCFSNLRRVLSSPKVDVPSCFVGLILENCQLPYANHGHVVLGNPSPILFYPISSTEVRCLVDVPGQKVPSISSGEMANHLKTVVAPQVPAELKEAFIAAVDKGNIRTAQNKSMPAAPVPTPGALLMGDAFNMRHPLTGGGMTVALSDIVVLRNLLKPLRDLHDSSSLCKYLESFYTLRKPVASTINTLAGALYKVFCASPDEARNEMRQACFDYLSLGGVYSTGPVALLSGLNPRPLSLVCHFFAVAIYGVGRLLFPFPSPKRLWIGARLISAASGIIFPIMKAEGFRQMFFPATVPAYYRAPPAK

SEQ ID NO: 5750 - protein, 533 aa, Quercus alba
MVVIDQHVLWTFFASLFGFVLLYIIRRNNNANNRKLKKKNSPQQCVDDNSFTDGEFRHVNGSDSGTDVIVVGAGVAGAALAYTLGKDGRRVHVIERDLTEPDRIVGELLQPGGYLKLVELGLEDCVEEIDAQRVLGYALFKEGKNTKLSYPLEKFHSDVSGRSFHNGRFIQRMREKAATLSNVKLEQGTVTSLLEENKTIRGVQYKTKDGQEHTAYAPLTIVCDGCFSNLRRALCNPKVDVPSCFVGLVLENCQLPFANHGHVILADPSPILFYPISGTEVRCLVDVPGQKLPSIANGEMAKYLKTMVAPQIPPELHDAFVSAIDKGNIRTMPNRSMPADPHPTPGALLMGDAFNMRHPLTGGGMTVALSDIVVLRDLLKPLRDLNDAASLSRYLESFYTLRKPVASTINTLAGALYKVFSASPDQARKEMRQACFDYLSLGGIFSTGPIALLSGLNPRPLSLVLHFFAVAIYGVGRLLLPFPSPQRLWIGARLIWSAAGIIFPIIKAEGVRQMFFPATVPAYYKAPSVKSDI

SEQ ID NO: 5751 - protein, 189 aa, Capsicum annuum
MADLLTGSILTVVLGLVAVFWFLVWKNSGRRKIEIIDPTTNSTATTTVYDGECRSKDGDDDVDIIVVGAGVAGAALAHTLGKERRRVKVIERDLTEPDRIVGELLQPGGYLKLQELGLEDCVEKIDAQRVFGYALFKDGKSTRLSYPLEKFHSDVSGRSFHNGRFIQRMREKAASLPNVKLEQGTVTSA

SEQ ID NO: 5752 - protein, 520 aa, Unknown
  Sequence found in Organisms: Citrus sinensis, Citrus clementina
MDHYIAGTLIAAVFLLLFVVRRNDSKKPRKVSTTYKTQNDVFRSSVNAGKNGSPTDVIIVGAGVAGAALAHTLGKDGRRVHVIERDVTEPDRIVGELLQPGGYLKLVELGLEDCVEEIDAQQVLGYALFKDGKSTRLSYPLEKFHADVSGRSFYNGRFIQRMREKAASRPNVRLEQGTVTSLLEENGTIKGVQYKTKDGQELRAYAPLTIVCDGCFSNLRRSLCKPKVDVPSCFVGLVLENCQLPFANHGHVILADPSPILFYPISSTEVRCLVDVPGQKVPSISNGEMANYLKAMVAPQVPPELHEAFVSAVERGNIRTMPNRSMPADPQPTPGALLMGDAFNMRHPLTGGGMTVALSDIVVLRNLLKPLHDFNDAASLGRYLESFYTLRKPVASTINTLAGALYKVFSSSPDQARKEMRQACFDYLSLGGVFSTGPVALLSGLNPRPLSLVLHFFAVAIYGVGRLLLPFPSPKRMWIGARLISGASGIIFPIIKAEGVRQMFFPATIPAVYRAPPVED

SEQ ID NO: 5753 - protein, 532 aa, Eucalyptus grandis
MAAGRLRNENSNGLCWVGGILASVLGVLILYRLVARKRRRNGGECVKSMRTAKDEESRSVNENGGGDFDVIVVGAGVAGSALAYTLGKDGRRVHVIERDLSEPDRIVGELLQPGGYLKLIELGLEDCVEKIDAQQVFGYALFKDGRNTRLSYPLEMFSSDVSGRSFHNGRFIQKMREKAATLPNVQLEQGTVTSLLEDNGTVKGIQYKTRTGQELTAYAPLTVVCDGCFSNLRRSLCDPKVDVPSCFVGLVLENCNLPYANHGHVILADPSPILFYPISSTEVRCLVDVPGQKVPSISNGEMANYLKTVVAPQVPPEILDAFVAAVDRGNMRTMPNRSMPAIPHPTPGALLMGDAFNMRHPLTGGGMTVALSDIVVLRDLLRPLRNLNDAPALCRYLESFYTLRKPVASTINTLAGALHKVFCASPDEARKEMRQACFDYLCLGGLFSTGPISLLSGLNPRPLSLVLHFFAVAIYGVGRLLLPLPSPKRIWIGFRLISGASGIIFPIIRAEGVRQMFFPATVPAYYRAPPVK

SEQ ID NO: 5754 - protein, 526 aa, Glycine max
MEDPYVLGWILCSVLSLLALYSLAFGGAGRRRASPEKRNELSETVTTSAGECRSEKRNGDADVIIVGAGVAGAALAHTLGKDGRRVHVIERDLSEPDRIVGELLQPGGYLKLIELGLEDCVDKIDAQQVFGYALFKDGKHTRLSYPLEKFHSDVSGRSFHNGRFIQRMREKAASIPNVRLEQGTVTSLIEEKGTIKGVQYKTKDGQELATYAPLTIVCDGCFSNLRRSLCNPKVDIPSCFVGLVLENCELPCANHGHVILGDPSPILFYPISSTEIRCLVDVPGQKVPSISNGEMGKYLKTTVAPQIPPQLYDAFIAAVDKGNIRTMPNRSMPADPHPTPGALLMGDAFNMRHPLTGGGMTVALSDIVVLRNLLRPLSDLNDAPTLCKYLESFYTLRKPVASTINTLAGALYKVFCASPDQARKEMRQACFDYLSLGGLFSEGPVSLLSGLNPRPLSLVLHFFAVAIYGVGRLLLPFPSPKRVWIGARLISGASAIILPIIKAEGIRQMFFPATVPAYYRTPPVAQ

SEQ ID NO: 5755 - protein, 528 aa, Cucumis sativus
MVDHCTFGWIFSAFLAFVIAFSFFLSPRKNRRGRGTNSTPRRDCLSSSATTNGECRSVDGDADVIIVGAGVAGSALAHTLGKDGRRVHVIERDLTEPDRIVGELLQPGGYLKLIELGLQDCVEEIDAQKVYGYALFKDGKSTRLSYPLENFQSDVSGRSFHNGRFIQRMREKAAFLPNVRLEQGTVTSLLEEKGTITGVQYKSKNGEQKTAYAPLTIVCDGCFSNLRRSLCNPMVDVPSCFVGLVLENCQLPYANLGHVVLGDPSPILFYPISSTEIRCLVDVPGQKVPSISNGEMEKYLKTVVAPQVPPQIHDAFIAAIEKGNIRTMPNRSMPAAPQPTPGALLMGDAFNMRHPLTGGGMTVALSDIVVLRNLLKPLKDLNDAPTLCKYLESFYTLRKPVASTINTLAGALYKVFCASSDQARKEMRQACFDYLSLGGIFSNGPVSLLSGLNPRPLSLVLHFFAVAIYGVGRLLLPFPSPKGIWIGARLVYSASGIIFPIIKAEGVRQMFFPATVPAYYRTPPVFNS

SEQ ID NO: 5756 - protein, 514 aa, Musa acuminata
MADQYLLGAVVASILGFLLLHVGFHGWKGRARRTAGKCGSGPVVPGDGGTEVIIVGAGVAGSALAYALGKDGRRVHVIERDLSEPDRIVGELLQPGGYLKLLELGLEDCVDEIDAQRVLGYALFKDDKSTKLSYPLEKFHSDIAGRSFHNGRFIQRMREKAASLPNVRLEQGTVTSLIEENGTVKGVVYKTKSGEEFKALSPLTIVCDGCFSNLRRTLCSPKVDVPSCFVGLVLENCQLPFPDHGHVILANPSPILFYPISSTEIRCLVDVPGQKVPSIANGEMANYLKTMVAPQVPTELHDSFVAAIDKGSIRTMPNRSMPAAPHPTAGALLMGDAFNMRHPLTGGGMTVALSDIVVLRNLLKPLHDLHDAAALCKYLESFYTLRKPVASTINTLAGALYKVFSASPDQARNEMRQACFDYLSLGGVFSSGPIALLSGLNPRPLSLVAHFFAVAIYGVGRLLLPFPSLERLWIGARLISGAAGIIFPIIKAEGVRQMFFPATVPAYYRAPPVN

SEQ ID NO: 5757 - protein, 358 aa, Vaccinium corymbosum
MREKAATLPNVRLEQGTVTSLLEENGIIKGVQYKTKTGEEIRSYAPLTIVCDGCFSNLRRSLCKPMVDVPSCFVGLVLENCKLPYPNHGHVILADPSPILFYPISSTEIRCLVDVPGKKIPSIANGELANYLKTSVAPQVPPELHKAFLAAIDKGNIRTMPNRSMPAAPYPTPGALLMGDAFNMRHPLTGGGMTVALSDIVVLRDLLKPLRDLNDSASLCKYLESFYTLRKPVASTINTLAGALYKVFCASPDQARKEMREACFDYLSLGGVCSTGPVALLSGLNPRPLSLVLHFFAVAIYGVGRLLLPFPSPKRLWIGARLISGASGIILPIIKAEGVRQMFFPATVPAYYRAPPGE

SEQ ID NO: 5758 - protein, 523 aa, Gossypium raimondii
MADSYVLGWILCSVMALVALCGVVLRRQKWKGISMRTEPMKTVLTRNGECGSADASHADIIIVGAGVAGSALAHTLGKDGRRVQVIERDLSEPDRIVGELLQPGGYLKLIELGLEDCVEEIDAQQVFGYALFKDGKHTQLSYPLEKFHSDVSGRSFHNGRFIQRMREKSASLPNVHLEQGTVTSLLEEKGIIRGVQYKTKDGPELTAFASLTIVCDGCFSNLRRSLCNPKVDIPSSFVGLVLENCHLPYSNHGHVILADPSPILFYPISSTETRCLVDVPGQKVPSIANGEMANYLKTIVAPQVPPEIYDSFVAAVDKGNIRTMPNRSMPAAPHPTPGALLMGDAFNMRHPLTGGGMTVALSDIVVLRDLLRPLHDLNDAPMLCKYLESFYTLRKPVASTINTLAGALYKVFCASPDQARKEMRQACFDYLSLGGVCSAGPISLLSGLNPRPLSLVLHFFAVAIYSLGRLLLPFPSPKRIWIGARLISGASGIIFPIIKAEGVRQMFFPATVPAYYRAPPTVK

SEQ ID NO: 5759 - protein, 523 aa, Gossypium hirsutum
MADWYLWAWILCSTMTLVVLRGSVLKRRKGNGISATRGESVKRVLAGNGECRSADGSDADVIIVGAGVAGSALAHTLGKDGRRVHVIERDLTEPDRIVGELLQPGGYLKLIELGLEDCVEEIDAQKVFGYALFKDGKHTRLSYPLENFHSDVSGRSFHNGRFIQRMREKAASLPSVRLEQGTVTSLLEEKGTIRGVQYKTKDGRELTAFAPLTIVCDGCFSNLRRSLCNPKVDVPSCFVGLVLENCHLPYSNHGHVILADPSPILFYPISSTEVRCLVDIPGQKVPSIANGEMTNYLKTIMAHQVPPEIYDSFVAAVDKGNIRTMPNRSMPASPYPTPGALLMGDAFNMRHPLTGGGMTVALSDIVVLRDLLRPLRDLNDGPNLCKYLESFYTLRKPVASTINTLAGALYKVFSASPDQARKEMRQACFDYLSLGGVFSTGPISLLSGLNPRPLSLVMHFFAVAIYGIGRLLVPFPSPKRIWIGARLITGASGIIFPIIKSEGVRQMFFPATVPAYYRAPPLK

SEQ ID NO: 5760 - protein, 528 aa, Mimulus guttatus
MIDQYIFGGFVASLFAFVLLYSLRRRTIGKTKGGASKAATASIDECVTSPAADGGSKAESGGDADVIIVGAGVAGAALAYTLGKEGRRVRVIERDLTEPDRIVGELLQPGGYLKLIELGLEDCLSNIDAQRVFGYALYKDGKDTKLSYPLEKFDSDVSGRSFHNGRFIQRMREKASTVANVRIEQGTVTSLLEENGTVKGVQYKTKKGEEITAYAPLTVVCDGCFSNLRRSLCTPEVENPSCFVGLILENCDLPHANHGHVVLGDPSPILFYPISSTEIRCLVDVPGQKVPSIASGEMANYLKTVVAPQIPPQLYNSFIAAIEKGNIRTMPNRSMPANPHPTPGALLMGDAFNMRHPLTGGGMTVALSDIVLLRDLLRPIHDLNDASILCKYLESFYTLRKPVASTINTLAGALYKVFCASPDPARNEMRRACFDYLSLGGVCSNGPISLLSGLNPSPLSLFLHFFSVAVFGVGRLLLPFPSPQRVWLGARLLSGASGIIFPIIKAEGVRQMFFPATVPAYYRSPPVN

SEQ ID NO: 5761 - protein, 528 aa, Trigonella foenum-graecum
MMDLYLLGWILSTVLSLFALYNLIFTERRNYGSPEKVNQREEDSVTSTDAGEIKSEKLNGDADVIIVGAGIAGAALAHTLGKDGRRVHVIERDLSEPDRIVGELLQPGGYLKLVELGLQDCVDNIDAQRVFGYALFKDGKHTRLSYPLEKFHSDVSGRSFHNGRFIQRMREKAASLPNVNLEQGTVISLLEEKGTIKGVQYKNKDGQALTAYAPLTIVCDGCFSNLRRSLCNPKVDNPSCFVGLILENCELPCANHGHVILGDPSPILFYPISSTEIRCLVDVPGTKVPSISNGDMTKYLKTTVAPQVPPELYDAFIAAVDKGNIRTMPNRSMPADPRPTPGAVLMGDAFNMRHPLTGGGMTVALSDIVVLRNLLKPLRDLNDAPALCKYLESFYTLRKPVASTINTLAGALYKVFSASPDPARKEMRQACFDYLSLGGLFSEGPISLLSGLNPRPLSLVLHFFAVAVFGVGRLLLPFPSPKRAWIGARLLSGASGIILPIIKAEGIRQMFFPATVPAYYRAPPASQE

SEQ ID NO: 5762 - protein, 359 aa, Gossypium hirsutum
MREKAATLPNVKLEQGTVTSLLEEKGTIIGVQYKTKDGEELRAYAPLTIVCDGCFSNLRRSLCNPKVDVPSCFVGLVLENCELPFSNHGHVILGDPSPILFYPISSTEVRCLVDVPGKKVPSVANGEMANHLKTVVAQQVPPELRDAFIAAVDKGNIRTMPNRSMPADPHPTPGALLMGDAFNMRHPLTGGGMTVALSDIVVLRDLLRPLHNLHDAASLTSYLESFYTLRKPVASTINTLAGALYKVFSASPDEARKEMRQACFDYLSLGGVFSTGPVALLSGLNPQPLSLVLHFFAVAIYGVGRLLLPFPSFQRMWIGARLIWSASGIIFPIIKAEGVRQMFFPATVPAVYRAPPVVN

SEQ ID NO: 5763 - protein, 518 aa, Tropaeolum majus
MDLKLTARSGGVYGLIVKNRRRRIEKSEDAEVRSECVKSVYSADAECRSDNGDVDVIIVGAGVAGAALAHTLGKDGRRVLVIERDLTEPDRIVGELLQPGGYLKLIELGLQDCVEAIDAQRIFGYALFKDGKSTQLSYPLEKFHSDVSGRSFHNGRFIQRMREKADTLPNVQLEQGTVTSLLEEKGTIKGVQYKTKTDQVLTANAPLTIVCDGCFSNLRRSLCNPKVDVPSCFVGLVLENCELPFANHGHVVLADPSPILFYPISSTEVRCLVDVPGQKVPSIANGEMANYLKTAVAPQIPPELYNSFLAAIDKGNIRTMPNRSMPAAPYPTPGALLMGDAFNMRHPLTGGGMTVALSDIVVLRDLLRPLLDLHDAPTLCKYLESFYTLRKPVASTINTLAGALYKVFCASPDQARNEMRKACFDYLSLGGVCSTGPVSLLSGLNPRPLSLVLHFFAVAVFGVGRLLLPFPSPKRIWIGARLISGASGIILPIIKAEGFRQMFFPATVPAYYRGPPAK

SEQ ID NO: 5764 - protein, 530 aa, Cannabis sativa
MVFDQYLLGGVIASLAGFVFLYNYSYRGKKIMSSTKAKSMELYSNGFVKTSSNGAVSPSGIPKEGTDVIIVGAGVAGAALAYTLAKDGRRVHVIERDLNEPDRIVGELLQPGGYLKLIELGLEDCVKEIDAQRVFGYALYKDGKSTKLSYPLEKFHSDVAGRSFHNGRFIQRMREKASSLSNVRLEQGTVTSLLEEKGTIKGVQYRNKAGQELTSHAPLTIVCDGCFSNLRRSLCKPQVDIPSCFVGLVLENCDLPYANHGHVILADPSPILFYPISSTEIRCLVDVPGQKVPSVANGEMATYLKSAVAPQIPPELNASFIAAIDKGNIRTMTNRSMPASPYPTPGALLMGDAFNMRHPLTGGGMTVALSDIVVLRNLLRPLHDLHDSSALCKYLESFYTLRKPVASTINTLAGALYKVFCASPDPARKEMREACFDYLSLGGICTNGPVALLSGLNPCPLSLVLHFFAVAVFGVGRLLIPFPSPRRMWIGARLISGASGIIFPIIKAEGVRQMFFPVTVPAYYRVPPVQ

SEQ ID NO: 5765 - protein, 514 aa, Gossypium raimondii
MAYEYIFGIFACFLGFVLFYYNTRTNKTAAAAASTVVSARNGEGTEGTATDIIIVGAGVAGAALAYTLGKDGRRVRVIERDLNEPDRIVGELLQPGGYLKLIELGLEDCVDEIDAQRVFGYALFKDGKNTKLSYPLENFHSDVAGRSFHNGRFIQRMRHKAASLPNVSLEQGSVTSLIEEKGTVKGIQYKTKDGQEFMAYAPLTIVCDGGFSNLRRSLSNPKVDVPSCFVGLILENCELPHANHGHVIIADPSPILFYPISSTEIRCLVDVPGQKVPSVSNGEMAHYLKTMVAPQIPPQLYTAFITAVNKGNIRTMTNRSMPAAPQPTPGALLLGDAFNMRHPLTGGGMTVALSDIVLLRDLLRPLHNLHDASALCRYLESFYTLRKPVASTINTLAGALYKVFSASADKAREEMREACFDYLSLGGAFSEGPISLLSGLNPHPISLVLHFFAVAIYGVGRLLLPFPSPTRIWTGARLISGASGIIFPIIRAEGVRQMFFPATVPAYYRAPPVD

SEQ ID NO: 5766 - protein, 522 aa, Tabernaemontana elegans
MDHYIFGTIWGVALGFLALYALFLRRNGGRRVAVENRDSYAATTTVIDGECRSRNSDVDIIIVGAGVAGAALAHTLGKDGRRVHVIERDLTEPDRIVGELLQPGGYLKLIELGLEDCVEGIDAQRVFGYALFKDGRKTRLSYPLERFHSDVAGRSFHNGRFIQRMREKAASLPNVRLEQGTVTSLLEENGTIRGVQYRTKSGEELTAYAPLTIVCDGCFSNLRRSLCDPKVDVASCFVGLVLENCQLPFANHGHVILGDPSPILFYPISSTEVRCLVDVPGQKVPSITNGEMVKHLKTVVAPQIPPELNEAFLAAVDKGNIRAMSNRSMPAAPHPTPGALLMGDAFNMRHPLTGGGMTVALSDIVVLRDLLRPLRDLNDVPTLCKYLESFYTLRKPVASTINTLAGALYKVFSASPDQARKEMRQACFDYLSLGGVFSAGPVSLLSGLNPRPLSLVCHFFAVAVYGVGRLLLPFPSLKRMWIGARLISSASGIIFPIIKAEGVRQMFFPATVPAYYRGPPAK

SEQ ID NO: 5767 - protein, 526 aa, Phalaenopsis aphrodite
MLQRYLFGGILASLLGFLLLLISRDKKKKKNNEPVNSGDSAAILMTGCGGGEAERGNADDQVEVIIVGAGVAGSALAYTLGKDGRRVHVIERDLTEPDRIVGELLQPGGYLKLVELGLEDCVEEIDAQHVFGYALFKDGQNTKLSYPLEKYGSHVAGRGFHNGRFVQRLREKAASLPNVRMEEGTVTSLLEENGIVKGVTYKSKAGYELKAFAPLTIVCDGCFSNLRRALCNPKVDIPSSFIGLVLENCKLPFSNHGHVILADPSPILFYPISSTEVRCLVDVPGRKVPSIANGEMANYLKTVVVSQIPCQLHDVFIAAVDKGKIRTMPNRSMPAAPHPTPGALLMGDAFNMRHPLTGGGMTVALSDIVVLHNLLKPLHDLHDASALCKYLESFYTLRKPVASTINTLAGALYKVFSGSPDQARNEMRQACFDYLSLGGTCSTGPVALLSGLNPRPMSLVTHFFAVAIFGVGRVLFPFPSPKRMWIGARLITGACEIIFPILKAEGFRQMFFPATVPAYYRAPPAN

SEQ ID NO: 5768 - protein, 523 aa, Gossypium raimondii
MADWYLWAWILCSTMTLVVLRCSVLKRRKGNGISPTRGESVKRVLAGNGECRSADGSDADVIVVGAGVAGSALAHTLGKDGRRVHVIERDLTEPDRIVGELLQPGGYLKLIELGLEDCVEEIDAQKVFGYALFKDGKHTRLSYPLENFHSDVSGRSFHNGRFIQRMREKAASLPNVRLEQGTVTSLLEEKGTIRGVQYKTKDGRELTAFAPLTIVCDGCFSNLRRSLCNPKVDVPSCFVGLVLENCHLPYSNHGHVILADPSPILFYPISSTEVRCLVDIPGQKVPSIANGEMTNYLKTIMAHQVPPEIYDSFVAAVDKGNIRTMPNRSMPASPYPTPGALLMGDAFNMRHPLTGGGMTVALSDIVVLHDLLRPLRDLNDGPNLCKYLESFYTLRKPVASTINTLAGALYKVFSASPDQARKEMRQACFDYLSLGGVFSTGPISLLSGLNPRPLSLVMHFFAVAIYGIGRLLVPFPSPKRIWIGARLITGASGIIFPIIKSEGVRQMFFPATVPAYYRAPPLK

SEQ ID NO: 5769 - protein, 523 aa, Gossypium hirsutum
MADWYLWAWILCSTMTLVVLRGSVLKRRKGNGISATRGESVKRVLAGNGECRSADGSDADVIVVGAGVAGSALAHTLGKDGRRVHVIERDLTEPDRIVGELLQPGGYLKLIELGLEDCVEEIDAQKVFGYALFKDGKHTRLSYPLENFHSDVSGRSFHNGRFIQRMREKAASLPNVRLEQGTVTSLLEEKGTIRGVQYKTKDGRELTAFAPLTIVCDGCFSNLRRSLCNPKVDVPSCFVGLVLENCHLPYSNHGHVILADPSPILFYPISSTEVRCLVDIPGQKVPSIANGEMTNYLKTIMAHQVPPEIYDSFVAAVDKGNIRTMPNRSMPASPYPTPGALLMGDAFNMRHPLTGGGMTVALSDIVVLHDLLRPLRDLNDGPNLCKYLESFYTLRKPVASTINTLAGALYKVFSASPDQARKEMRQACFDYLSLGGVFSTGPISLLSGLNPRPLSLVMHFFAVAIYGIGRLLVPFPSPKRIWIGARLITGASGIIFPIIKSEGVRQMFFPATVPAYYRAPPLK

SEQ ID NO: 5770 - protein, 526 aa, Medicago truncatula
MDLYNIGWILSSVLSLFALYNLIFAGKKNYDVNEKVNQREDSVTSTDAGEIKSDKLNGDADVIIVGAGIAGAALAHTLGKDGRRVHIIERDLSEPDRIVGELLQPGGYLKLVELGLQDCVDNIDAQRVFGYALFKDGKHTRLSYPLEKFHSDVSGRSFHNGRFIQRMREKAASLPNVNMEQGTVISLLEEKGTIKGVQYKNKDGQALTAYAPLTIVCDGCFSNLRRSLCNPKVDNPSCFVGLILENCELPCANHGHVILGDPSPILFYPISSTEIRCLVDVPGTKVPSISNGDMTKYLKTTVAPQVPPELYDAFIAAVDKGNIRTMPNRSMPADPRPTPGAVLMGDAFNMRHPLTGGGMTVALSDIVVLRNLLKPMRDLNDAPTLCKYLESFYTLRKPVASTINTLAGALYKVFSASPDEARKEMRQACFDYLSLGGLFSEGPISLLSGLNPRPLSLVLHFFAVAVFGVGRLLLPFPSPKRVWIGARLLSGASGIILPIIKAEGIRQMFFPATVPAYYRAPPVNAF

SEQ ID NO: 5771 - protein, 524 aa, Amsonia hubrichtii
MDHYIFGTILGVVLGFVALCGLLLRRNGGQTVENSENYAASTTTTTTVIDGECRSRNSDIDIIIVGAGVAGAALAHTLGKDGRRVHVIERDLTEPDRIVGELLQPGGYLKLIELELEDCVEGIDAQRVFGYALFKDGKKTRLSYPLESFHSDVAGRSFHNGRFIQRMREKAASLPNVRLEQGTVTSLLEENGTIRGVQYKTKSGEELTAYAPLTIVCDGCFSNLRRSLCDPKVDVPSCFVGLVLENCQLPFANHGHVILGDPSPMLFYPISSTEVRCLVDVPGQKVPSISNGEMVKYLKTVVAPQVPPQLNEAFLAAVEKGNIRTMPNRSMPAAPHPTPGALLMGDAFNMRHPLTGGGMTVALSDIVVLRDLLRPLRDLNDAPTLCKYLESFYTLRKPVAATINTLAGALYKVFSASPDQARKEMRQACFDYLSLGGVFSAGPVSLLSGLNPRPLSLVCHFFAVAVYGVGRLLLPFPSPKRLWIGARLISSASGIIFPIIKAEGVRQMFFPATVPAYYRGPPVK

SEQ ID NO: 5772 - protein, 535 aa, Manihot esculenta
MAFVIDKFILGTFFASISVFFLLCIFRRNHQNLKNEQKFKEKAAFKTQNDNVQRPEDGSDPDVIIVGAGVAGTALACTLGKDGRRVQVIERDLTEPDRIVGELLQPGGYLKLIELGLEDCVEEIDAQRVLGYALFKDGKNTRLSYPLENFHSDIAGRSFHNGRFIQRMREKAATIPNVKLVQGTVTSLLEENGTIKGVQYKTKDGQEHRAYAPLTVVCDGCFSNLRRSLCNPKVAVPSCFVGLILENCQLPFANHGHVILADPSPILFYPISSTEVRCLVDVPGQKLPSIANGEMAKYLKDVVAPQIPPQLHDAFISAIDKGNIRTMPNRSMPADPHPTPGALLMGDAFNMRHPLTGGGMTVALSDIVVLRDLLHPLCDLNDADSLAKYLESFYTLRKPVASTINTLAGALYKVFSASPDEARKEMREACFDYLSLGGIFSSGPVALLSGLNPRPLSLVLHFFAVAIYGVGRLLLPFPSPKAIWIGARIISSASGIIFPIIRAEGVRQMFFPATVPAIYRHPPVDDKSDDVQKSR

SEQ ID NO: 5773 - protein, 519 aa, Cajanus cajan
MMDSYVLGSIICALLGLLALLNFLLAPKNNRCADNNITTAAGQCISSNRRGDGDVDVIIVGAGVAGSALAHTLGKDGRRVLVIERDLSEPDRIVGELLQPGGYLKLIELGLEDCVEKIDAQQVFGYALFKDGKHTRLSYPLDKFHSNVTGRSFHNGRFIQRMREKAASLPNVRLEQGTVTSLLEEKGIIKGVLYKTKDSKELSACAPLTIVCDGCFSNLRRSLCNPKVDVPSCFVGLVLENCELPCANHGHVILGDPSPVLFYPISSTEIRCLVDVPGQKVPSISNGEMENYLKTVVAPQVPSELHDAFIAAVDKGNIRTMPNRSMPAAPYPTPGALLMGDAFNMRHPLTGGGMTVALSDIVVLRNLLRPLRDLNDASSLCKYLESFYTLRKPVASTINTLAGALYKVFCASPDPARKEMRQACFDYLSLGGLFSEGPVSLLSGLNPRPLSLVLHFFAVAIYGVGRLLLPFPSPKRIWIGVRLISSASGIILPIIKAEGVRQMFFPATVPAYYRNPPAS

SEQ ID NO: 5774 - protein, 528 aa, Cucumis melo
MVDHCAFGWIFSALLAFPIALSLFLSPWRNRRVRGTDSTPRSASVSSSATTNGECRSVDGDADVVIVGAGVAGSALAHTLGKDGRRVHVIERDLTEPDRIVGELLQPGGYLKLIELGLQDCVEEIDAQKVYGYALFKDGKNTRLSYPLENFHSDVSGRSFHNGRFIQRMREKAASLPNVRLEQGTVTSLLEEKGTITGVQYKSKNGEQKTAYAPLTIVCDGCFSNLRRSLCTPMVDVPSYFVGLVLENCQLPYANLGHVVLGDPSPILFYPISSTEIRCLVDVPGQKVPSISNGEMEKYLKTVVAPQVPPQIHDAFIAAIEKGNIRTMPNRSMPAAPQPTPGALLMGDAFNMRHPLTGGGMTVALSDIVVLRNLLKPLKDLNDAPTLCKYLESFYTLRKPVASTINTLAGALYKVFCASPDQARKEMRQACFDYLSLGGIFSNGPVSLLSGLNPRPLSLVLHFFAVAIYGVGRLLLPFPSLKGIWIGARLVYSASGIIFPIIKAEGVRQMFFPATVPAYYRTPPVLNS

SEQ ID NO: 5775 - protein, 526 aa, Papaver somniferum
MIEYILGGVLAFLVGFFVFYSSSSQKNDIKKNKVVTVEENESVDDSVGENNGEFKSKSKEETDVIIVGAGVAGAALAYTLGKDGRRVHVIERDLTEPDRIVGELLQPGGFLKLVELGLGDCVEEIDAQRVFGYALFKDGKNTKVSYPLEEFQSDVAGRSFHNGRFIQRMREKAATLPNVRLEQGTVTSLLEENGTVKGITYKTKNGEELKAYAPLTVVCDGCFSNLRRSLCTPKVDVPSCFVGLILENCELPYPNHGHVVLADPSPILFYQISSHEVRCLVDVPGQKVPSLSNGDMANYLKTAVAPQIPSQLHDSFISAIDKGNIRTMPNRSMPALPHPTPGAILMGDAFNMRHPLTGGGMTVALADIVLLRNLLKPLMDLNDASSLCRYLESFYTLRKPVASTINTLAGALYKVFCVSPDEARTEMREACFDYLSLGGVFSSGPVALLSGLNPRPLSLVCHFFAVAIYGVGRLLLPFPSPKRLWIGARLISSASGIIFPIIKAEGVRQMFFPATLSAYYRAPPVN

SEQ ID NO: 5776 - protein, 472 aa, Sesamum indicum
MIDQYILGGFVASLVAFVLLYNLPRKTRKTNKVSKVGRGDECIKTSAVGGGSGTEAGGDADIIIVGAGVAGAALAYTLGKDGRRVHVIERDLTEPDRIVGELLQPGGYLKLMELGLEDCVGDIDAQRVFGYALYKDGKATKLSYPLEKFDADVSGRSFHNGRFIQRMREKAATLANVRLEQGTVTSLLEEKGTVKGVQYKTKNGEEITAYAPLTIVCDGCFSNLRRSLCTPQVDIPSCFVGLILENCELPYVNHGHVVLADPSPILFYKISSTEIRCLVDVPGQKVPSVASGEMANYLKTAVAPQIPPQLYDAFIAAIEKGAIRMMPNRSMPANPHPTPGALLMGDAFNMRHPLTGGGMTVALSDIVVLRDLLRPLHDLHDAPTLCKYLESFYTLRKPVASTINTLAGALYKVFCASPDPARKEMREACFDYLSLGGIFSEGPVSLLSGLNPRPLSLFLHFLPWPFMELADY

SEQ ID NO: 5777 - protein, 523 aa, Gossypium hirsutum
MADWYLWAWILCSTMTLVVLRCSVLKRRKGNGISPTRGESVKRVLAGNGECRSADGSDADVIIVGAGVAGSALAHTLGKDGRRVHVIERDLTEPDRIVGELLQPGGYLKLIELGLEDCVEEIDAQKVFGYALFKDGKHTRLSYPLENFHSDVSGRSFHNGRFIQRMREKAASLPSVRLEQGTVTSLLEEKGTVRGVQYKTKDGRELTAFAPLTIVCDGCFSNLRRSLCNPKVEVPSCFVGLVLENCHLPYSNHGHVILADPSPILFYPISSTEVRCLVDIPGQKVPSIANGEMTNYLKTIMAHQVPPEIYDSFVAAVDKGNIRTMPNRSMPASPYPTPGALLMGDAFNMRHPLTGGGMTVALSDIVVLHDLLRPLRDLNDGPNLCKYLESFYTLRKPVASTINTLADALYKVFSASPDQARKEMRQACFDYLSLGGVFSTGPISLLSGLNPRPMSLVMHFFAVATYGIGRLLVPFPSPKRIWIGARLITGASGIIFPIIKSEGVRQMFFPATVPAYYRAPPLK

SEQ ID NO: 5778 - protein, 527 aa, Lotus japonicus
MDYQYLLGGILACYACSLAFLFVLYSFAAKRNATSSSLLHLKSNGSAKTSENGICQQKGEGSIDVIIVGAGVAGAALAYTLGKDGRRVHVIERDLSEPDRIVGELLQPGGYLKLIELGLEDCVDEIDAQKVFGYALYKDGKDTKLSYPLEKFHSDVSGRSFHNGRFIQRMREKASSLLNVNLEQGTVTSLLEENGTITGVHYKTKSGQELIAKAPLTVVCDGCFSNLRRSLCNPKVEVPSHFVGLVLENCNLPYANHGHVILGDPSPILFYPISSTEIRCLVDVPGQKLPSLGNGEMALYLKTVVAPQVPPELYTSFVAAVDKGNMRTMPNRSMPASPHPTPGALLMGDALNMRHPLTGGGMTVALADIVVLRNLLRPLRDLRDASSLCKYLESFYTLRKPVASTINILAGALYKVFCASPDPAMKEMRQACFDYLSLGSVFSEGPTALLSGLNPRPLSLVLHFFAVAIYGVGRLMIPFPSPKRIWIGARLISGAAGIIFPIIKAEGVRQMFFPAMVPAYYRVPPVY

SEQ ID NO: 5779 - protein, 476 aa, Gossypium hirsutum
RRMLAWKWSGDEVIIVGAGVAGAALAYTLGKDGRRVHVIERDLTEPDRIVGELLQPGGYLKLVELGLEDCVEDIDAQRVFGYALFKDGRNTKLSYPLEKFQADVSGRSFHNGRLIQRMREKAATLPNVKLEQGTVTSLIEEKGTIIGVQYKTKDGEELRAYAPLTIVCDGCFSNLRRSLCNPKVDVPSCFVGLVLENCELPFSNHGHVILADPSPILFYPISSTEVRCLVDVPGKKVPSVANGEMANHLKTVVAQQVPPELRDAFIAAVDKGNIRTMPNRSMPADPHPTPGALLMGDAFNMRHPLTGGGMTVALSDIVVLRDLLRPLHNLHDAASLTSYLESFYTLRKPVASTINTLAGALYKVFSASPDEARKEMRQACFDYLSLGGIFSTGPVALLSGLNPRPLSLVLHFFAVAIYGVGRLLLPFPSFQRMWIGARLISSASGIIFPIIKAEGVRQMFFPATVPAVYRAPPVVN

SEQ ID NO: 5780 - protein, 535 aa, Manihot esculenta
MAIVIDKFIFGTFFASLFGFFVLCFLRRKHQNLENKQKFKEKAAFKTQNYNVQRPENSSGPDVIIVGAGVAGAALACTLGKDGRQVHVIERDLTEPDRIVGELLQPGGYLKLMELGLEDCVEEIDAQRVLGYALFKDGKVTRLSYPLENFHSDVAGRSFHNGRFIQRMREKAAKIPNVKLQQGTVTSLLEENGTINGVQYKTKDGQELRVHAPLTVVCDGCFSNLRRSLCNPKVDVPSYFVGLVLENCELPFANHGHVILADPSPILCYPISSTEVRCLVDVPGQKVPSIANGEMSKYLKDVVAPQIPPVLHDAFISAIDKGSIRTMPNRSMPADPHPTPGALLMGDAFNMRHPLTGGGMTVALSDIVVLRDLLNPLRDLNDAASLTKYLESFYTLRKPVASTINTLAGALYKVFCASPDEARKEMREACFDYLSLGGVFSSGPVALLSGLNPSPLSLFLHFFAVAIYGVGRLLLPFPSPKAMFIGVRLISSASGIIFPIIKAEGVRQMFFPATVPAIYRHPPVNDKADDLLKSS

SEQ ID NO: 5781 - protein, 519 aa, Medicago truncatula
MIDPYGFGWITCTLITLAALYNFLFSRKNHSDSTTTENITTATGECRSFNPNGDVDIIIVGAGVAGSALAYTLGKDGRRVLIIERDLNEPDRIVGELLQPGGYLKLIELGLDDCVEKIDAQKVFGYALFKDGKHTRLSYPLEKFHSDIAGRSFHNGRFILRMREKAASLPNVRLEQGTVTSLLEENGTIKGVQYKTKDAQEFSACAPLTIVCDGCFSNLRRSLCNPKVEVPSCFVGLVLENCELPCADHGHVILGDPSPVLFYPISSTEIRCLVDVPGQKVPSISNGEMAKYLKTVVAPQVPPELHAAFIAAVDKGHIRTMPNRSMPADPYPTPGALLMGDAFNMRHPLTGGGMTVALSDIVVLRNLLKPLRDLNDASSLCKYLESFYTLRKPVASTINTLAGALYKVFCASPDPARKEMRQACFDYLSLGGLFSEGPVSLLSGLNPCPLSLVLHFFAVAIYGVGRLLLPFPSPKRLWIGIRLIASASGIILPIIKAEGIRQMFFPATVPAYYRAPPDA

SEQ ID NO: 5782 - protein, 537 aa, Panax ginseng
MNSSSSTSTTDTLHSFMEALLIDQYFLGWIFAFLFGFLLLLNFKRKREKNNSTEFGTDDSNGYYTPENIAGSTDVIIVGAGVAGSALAYTLAKDGRRVHVIERDLTEQDRIVGELLQPGGYLKLIELGLEDCVNEIDAQRVFGYALYMDGKNTRLSYPLEKFHSDVAGRSFHNGRFVQRMREKAASLPNVRMEQGTVTSLVEKKGSVKGVQYKTKDGQELSAFAPLTIVCDGCFSNLRRSLCNPKVEVPSCFVGLILENIDLPHINHGHVILADPSPILFYKISSTEIRCLVDVPGQKVPCISNGELANYLKTVVAPQVPKQLYNSFIAAVDKGNIRTMPNRSMPADPHPTPGALLLGDAFNMRHPLTGGGMTVALSDIVLIRDLLRPLRDLHDSSTLCKYLESFYTLRKPVASTINTLAGALYKVFCASPDKARQEMRNACFDYLSLGGICSQGPIALLSGLNPRPISLFLHFFAVAIYGVGRLLIPFPSPKRMWLGARLILGASGIIFPIIKSEGLRQMFFPATVPAYYRAPPIH

SEQ ID NO: 5783 - protein, 616 aa, Fragaria vesca
MQLHKPIFQTHLPPQPSSQLFAQTHLPHKTHLPSISLCFHKPTTPESLTSSTCILTQTEKRTKQGHSPSSSCSYSSSGSCNSSFNSKMATMMAIDPHVVWTFLASLLGFLLLFLLRRRNYGNATAKDKGNVKNKNKTSEDHVSEECLKSSGTDVIIVGAGVAGAALAHTLGKEGRRVRVIERDLTEPDRIVGELLQPGGYLKLIDLGLEDCVEEIDAQRVLGYALFKDGKNTTLSYPLEQFHSDVAGRSFHNGRFIQRMREKAATLPNVQLEQGTVTSLLEENGIIKGVQYKTKDGQELQAHAPLTIVCDGCFSNLRRTLCKPQVEAPSCFVGLILENCELPFINHGHVILADPSPILFYQISSTEVRCLVDVPGQKVPPIANGAMANYLKNVVAPQLPPELHDPFVSAIDKGNIRTMPNRSMPANPQPTPGALLMGDAFNMRHPLTGGGMTVALSDIVILRDLLKPLRDINDAPSLCNYLESFYTLRKPVSSTINTLAGALYKVFSASPDQARKEMRQACFDYLSLGGACSTGPVALLSGLNPRPLSLVLHFFAVAIYGVGRLLLPFPSPKRIWIGVRLIWGAAGIIFPIIKAEGVRQMFFPATIPAYHRAPPAN

SEQ ID NO: 5784 - protein, 525 aa, Phaseolus vulgaris
MLDTYVFGWIICAALSVFVIRNFVFAGKKCCASSETDASMCAENITTAAGECRSSMRDGEFDVLIVGAGVAGSALAYTLGKDGRQVLVIERDLSEPDRIVGELLQPGGYLKLIELGLEDCVDKIDAQQVFGYALFKDGKHIRLSYPLEKFHSDVAGRSFHNGRFIQRMREKAASLPNVRLEQGTVTSLLEEKGVIKGVQYKTKDSQELSVCAPFTIVCDGCFSNLRRSLCDPKVDVPSCFVGLVLENCELPCANHGHVILGEPSPVLFYPISSTEIRCLVDVPGQKVPSISNGEMAKYLKTVIAPQVPHELHNAFIAAVDKGSIRTMPNRSMPAAPYPTPGALLMGDAFNMRHPLTGGGMTVALSDIVVLRNLLRPLRDLNDAPSLCKYLESFYTLRKPVASTINTLAGALYKVFCASSDPARKEMRQACFDYLSLGGQFSEGPISLLSGLNPRPLTLVLHFFAVATYGVGRLLLPFPSPKRMWIGLRLISSASGIIMPIIKAEGVRQMFFPATVPAYYRNPPAA

SEQ ID NO: 5785 - protein, 527 aa, Euonymus alatus
MVDHFVLGWILASVFGLFTLYLVVLKRTNDEKRAILEARREGMNSLNTINGECRSSHGDDVDVIIVGAGVAGSALSHTLGKDGRRVRVIERDVTEPDRIVGELLQPGGYLKLIELGLEDCVEEIDSQRVFGYALFKDGKSTRLSYPLEKFHSDVSGRSFHNGRFIQRMRQKVASLPNVQLEQGTVTSLLEANGIIRGVQYKTKSGEELKAYAPLTIVCDGCFSNLRRSLCKPKVDVPSCFVGLILENCNLPYANHGHVILGDPSPILFYPISSTEVRCLVDVPGQKVPSISNGELAKYLKTVVAPQLPPEIHDSFVAAVDKGNLRTMPNRSMPASAYPTPGALLMGDAFNMRHPLTGGGMTVALSDIVVLRNLLRPLHDLNDAPSLCKYLESFYTLRKPVASTINTLAGALYKVFCASPDQARKEMREACFDYLSLGGIFSAGPVSLLSGLNPRPLSLVCHFFAVAIFGVGRILLPFPSPNRIWIGARVILGASGIIFPIIKAEGVRQMFFPATVPAYYRAPPPTTK

SEQ ID NO: 5786 - protein, 526 aa, Tabernaemontana elegans
MVVIDQYILGAFLVSLSGFVFLYSQLRRKTKKYKASKFERKDEYIKTSTNVDLRSDKGDGTDIIIVGAGVAGSALAYTLGKDGRRVHVIERDLTEPDRIVGELLQPGGYLKLIELGLEDCLRNIEAQQVFGYAIYNDGKDTKLSYPLEKFDSDVSGRSFHNGRFIQRMREKAATLSNVRLEQGTVTSLIEENGTVKGVHYKTKDGQELIACAPLTIVCDGCFSNLRRSLCEPKVDVPSCFVGLVLENCELPYANHGHVILADPSPILFYPISNTEIRCLVDVPGQKVPSISNGEMAKYLKNVVAPQIPPQLYKAFIAAIDKGNIRTMPNRSMPANPHPTPGALLLGDAFNMRHPLTGGGMTVALADIVLLRDLLRPLHNLHDASTLCNYLESFYTLRKPVASTINTLAGALYKVFCASPDPARQEMRRACFDYLSLGGIFSSGPVALLSGLNPRPLSLVCHFFAVAVYGVGRLLIPFPSPKRAWLGARLLSGASGIILPIIRAEGVRQMFFPATVPAYYRAPPANE

SEQ ID NO: 5787 - protein, 545 aa, Panax ginseng
MELERSYRENDEYFLMFAATLLFGFVLYLFTLRRRRRRREKKGGAGSMEIINGAYKMTSSSEVNGHCTPEDIAGSSDDVIIVGAGVAGSALAYTLAKDGRRVHVIERDLTEQDRIVGELLQPGGYLKLVELGLEDCVNEIDAQRVFGYALYMDGKNTRLSYPLEKFHADVAGRSFHNGRFIQRMREKAASLPNVRMEQGTVTSLVEQKGTVKGVRYKTKNGQEMSAAYAPLTIVCDGCFSNLRHSLCNPKVDVPSCFVGLILENIDLPHINHGHVILADPSPILFYKISSTEIRCLVDVPGQKVPSIANGELAHYLKTSVAPQIPPELYKSFIAAIDKGKIKTMPNRSMPADPHSTPGALLLGDAFNMRHPLTGGGMTVALSDIVLIRDLLRPLRDLHDSSTLCKYLESFYTLRKPVASTINTLAGALYKVFCASPDKARQEMRDACFDYLSLGGICSEGPIALLSGLNPRPMSLFFHFFAVAIYGVGRLLIPFPSPRKMWLGARLISGASGIIFPIIKSEGVRQMFFPATVPAYYRAPPITKKM

SEQ ID NO: 5788 - protein, 544 aa, Euphorbia esula
ASSPSYLIMEVVFDTYILGTFFASLFAFLLLYIFRPNVKKMGKIKEFSSSFNTQNDSTITPPPNLSGTDVIIVGAGVAGAALAHTLGKEGKRVHVIERDLKEPDRIVGELLQPGGYLKLMELGLEDCVEEIDAQRIVGYALFKDGNHTKLTYPLEKFDADVSGKSFHNGRFIQRMREKASKLTNNVQLEQGTVTSLLEENGIVRGVQYKTKDGQERKAYAPLTIVCDGCFSNLRRSLCNPKVDVPSHFVGLVLENCDLPLANHGHVILADPSPILFYPISSTEVRCLVDVPGQKLPSIASGEMAKYLKTVVAPQIPPQLYEAFIAAIDKGNIRTMPNRSMPANPHPTPGALLMGDAFNMRHPLTGGGMTVALSDIVLLRDLLKPLRDLNDAYALTKYLESFYTLRKPVASTINTLAGALYKVFSASPDEARKEMREACFDYLSLGGSCSMGPVALLSGLNPSPLSLVVHFFGVAIFGVGRLLVPFPTPKGMWIGARIIYSASGIIFPIIRAEGVRQVFFPATVPAIYRHPPPAALVNEKSVEAY

SEQ ID NO: 5789 - protein, 230 aa, Sarracenia psittacina
MREKASSLPNVRVEQGTVTSLLEEKGIIKGVQYKTKDGHELTAYAPLTIVCDGCFSNLRRSLCNPKVEVPSCFVGLILENCQLPSANHGHVILGDPSPILFYPISSTEIRCLVDVPGQKVPSISSGEMAQYLKTVVAPQVPPELYNAFIAAVDKGNIRTMPNRSMAASPYPTPGALLMGDAFNMRHPLTGGGMTVALSDIVVLRDLLRPLRDLNRSRCLVQISRNILHSA

SEQ ID NO: 5790 - protein, 531 aa, Amsonia hubrichtii
MVVIDQYILGAFLASSLGFFFLYTKLRRKTKKTYRPSKVERKDEYIKTSANTDRRSHKRDGTDIIIVGAGVAGSALAYTLGKDGRRVHVIERDLTEPDRIVGELLQPGGYLKLVELSLQDCVNNIDAQRVYGYAIYKDGKDTKLTYPLEKFEADVSGRSFHNGRFIQRMREKAATLPNVRLEQGTVISLIEENGTVKGVQYKTKDGQEMIAHAPLTVVCDGCFSNLRRSLCDPKVEVPSCFVGLVLENTELPYANHGHVILGDPSPILFYPISSTEVRCLVDVPGQKVPSISNGEMAKYLKNVVAPQIPPQLYKAFIAAIDKGNIRTMPNRSMPANPHPTPGALLLGDAFNMRHPLTGGGMTVALSDIVILRDLLRPLHDLHDSSTLCSYLESFYTRRKPVASTINTLAGALYKVFCASPDPARQEMRQACFDYLSLGGIFSSGPVALLSGLNPRPLSLVAHFFAVAVYGVGRLLIPYPSPQRAWLGARLISGASGIIFPIIRAEGVRQMFFPATVPAYHRAPPVDDKLAT

SEQ ID NO: 5791 - protein, 525 aa, Aristolochia fimbriata
MLLVQYLLGGFVAALLGFALLPGLRRRKKKSKGDEGNSTGIQTYGENVVGKGARDGSTDVIVVGAGVAGSALAYTLGKDGRNVLVIERDLSEPDRIVGELLQPGGYLKLIELGLEDCVEAIDAQRVLGYALFKDGKDTKVSYPLEKFDDDVSGRSFHNGRFIQRMREKAASLPNVKLEQGTVTFLIEDNGTVKGVNYKTKNGEELKAHAPLTVVCDGCFSNLRRSLCTPKVEVPSHFVGLVLENCELPYPNHGHVILADPSPILFYPISSTEVRCLVDVPGQKLPSVANGEMANYLKTVVAPQLPAQLHDAFISAIDRGTVRTMPNKSMPASPDPTPGALLMGDAFNMRHPLTGGGMTVALADIAVLHNLLTPLRDLSDSSALCRYLESFYTLRKPTASTINTLAGALYKVFCASPDEAMKEMRQACFDYLSLGGVFSSGPVALLSGLNPRPLSLVCHFFAVAIYGVGRLLLPFPSPKRLWIGARLLSGASNIILPIIKAEGVRQMFFPASVPAYYRTPPTGEKR

SEQ ID NO: 5792 - protein, 177 aa, Trigonella foenum-graecum
GAALAYTLGKDGRRVHVIERDLSEPDRIVGELLQPGGYLKLLELGLEDCVDEIDAQRVFGYALYKDGKNTKLSYPLEKFNSDVSGRSFHNGLFIQRMREKASSLPNVKLEQGTVTSLLEENGTVKGVNYKNKSGQEFTTKAPLTVVCDGCFSNLRRSLCNPKVEVPSHFVGLVFGEL

SEQ ID NO: 5793 - protein, 528 aa, Catharanthus roseus
MVVIDQYILGAFLVSSFGFIFLYSQLRRKTKKFKSNSKSERKDDYIKTSIHVDRRSDQGNGTDIIIVGAGVAGSALAYTLGKDGRRVHVIERDLTEPDRIVGELLQPGGYLKLIELGLEDCLRSIDAQQVFGYAIYKDGKDTKLSYPLEKFESDISGRSFHNGRFIQRMREKAATLPNVRLEQGTVTSLIEENGTVNGVQYKTKDGQEITSHAPLTIVCDGCFSNLRRSLCDPKVDVPSCFVGLVLENCELPYANHGHVILGDPSPILFYPISSTEVRCLVDVPGQKVPSISNGEMAKYLKNVVAPQIPPQLYEAFIAAIDKGNIRTMPNRSMPANPHPTPGALLLGDAFNMRHPLTGGGMTVALSDIVVLRNLLKPLRDLHDPSTLCSYLESFYTLRKPVASTINTLAGALYKVFCASPDPARQEMRQACFDYLSLGGIFSSGPVALLSGLNPKPLSLVLHFFAVAVYGVGRLLIPYPSPKRAWLGVRLLSGASGIIFPIIRAEGVRQMFFPVTVPAYFRAPPLLNK

SEQ ID NO: 5794 - protein, 532 aa, Coffea canephora
MDQYVWETILAVALGFVAVYGILARNANARRKSFGKGGAEDREPRATAATTPIDGIFRSKNNDASDDADVIIVGAGVAGAALAHTLGKDGRRVYVIERDLSEPDRIVGELLQPGGYLKLIELGLEDCVEGIDAQRVFGYALFKDGKRTRVAYPLEKFDSDVSGRSFHNGRFIQRMREKAASLPNVRLEQGTVTSLLEEKGVIRGVQYKTKSGEELIKYAPLTVVCDGCFSNLRRSLCDPKVDVPSCFVGLVLENCQLPFADHGHVVLADPSPILFYPISSTEVRCLVDVPGQKVPSISNGEMAKYLKTTVAPQVPLELHDAFIAAVDKGNIRTMPNRSMPAAPHPTPGALLLGDAFNMRHPLTGGGMTVALSDIVVLRDLLRPLGDLNDPPTLCKYLESFYTLRKPVSATINTLAGALYKVFCSSSDEARKEMRQACFDYLSLGGVFSNGPVSLLSGLNPRPLSLVCHFFAVAIYGVGRLLLPFPSPKRMWIGARLISSASGIIFPIIKAEGVRQMFFPVTVPAYYRAPPAK

SEQ ID NO: 5795 - protein, 525 aa, Medicago truncatula
MDYQYILGGILACSLAFVFVVYGFGEKKKTGSSSMDVKSNGYAKTSSENGICSQEIVGETDIIIVGAGVAGAALAYTLGKDGRRVHVIERDLTEPDRIVGELLQPGGYLKLLELGLEDCVDEIDAQRVFGYALYKDGKNTKLSYPLEKFDSDVSGRSFHNGRFIQRMREKASTIPTVKLEQGTVTSLLEENGTIKGVNYKNKSGQEFTAKAPLTIVCDGCFSNLRRSLCNPKVEVPSHFVGLILENCNLPHANHGHVILGDPSPILFYPISSTEIRCLVDVPTGQKLPSLGNGEMANYLKTVVAPQVPPELHASFIAAVDKGNIRSMPNRSMPASPYPTPGALLMGDAFNMRHPLTGGGMTVALSDIVLLRNLLKPLRNLHDASALCIYLESFYTLRKPVASTINTLAGALYKVFCASPDPASIEMRRACFDYLSLGGVCSDGPIALLSGLNPRPLSLVLHFFAVAVFGVGRLLIPFPSPKRMWIGARLISGASGIIFPIIKAEGVRQMFFPASVPAYYRMPPVH

SEQ ID NO: 5796 - protein, 535 aa, Malus domestica
MAATVAVDPYVLWTFFASLLGFLALSVLRRRNSDHAKSNAQKNKSNTTIVQDKSINSSDDGEFPPIHGSGTDVIVVGAGVAGAALALTLAKEGRHVHVIERDLTEPDRIVGELLQPGGYLKLMELGLEDCVEEIDAQRVVGYVLFKDGKNTRLTYPLEQFHSDVAGRSFHNGRFIQRMRQKAAKLPNVQLEQGTVTSLLEVNGTIKGVRYKTKDGQELQAHAPLTIVCDGCFSNLRRTLCKPQVEVPSCFVGLILENCKLPFANHGHVILADPSPILFYQISSTEVRCLVDVPGQRVPPIANGAMANYLKTAVAPQVPPELHDAFVAAIDKGNIRTMPNRSMPANPQPTPGALLLGDAFNMRHPLTGGGMTVALSDIVVLKDLLKPLRNLHDAASLCTYLESFYTLRKPVASTINTLAGALYKVFSTSPDEARTEMRQACFDYLSLGGACSTGPVALLSGLNPCPLNLVLHFFAVAVYGVGRLLLPFPSPRRVWIGARLLLSASGIIFPIIKAEGVRQMFFPATIPAHHRAPPAE

SEQ ID NO: 5797 - protein, 525 aa, Glycine max
MVDPYVLGWIICAVLSLVALRNFAFARKNRCHSSETDATRRAENVTTAAGECRSSSRDGDVDVIIVGAGVAGSALAHTLGKDGRRVLVIERDLSEQDRIVGELLQPGGYLKLIELGLEDCVEKIDAQLVFGYALFKDGKHTRLSYPLEKFHSDVAGRSFHNGRFIQRMREKAASLSNVRLEQGTVTSLLEEKGVIKGVHYKTKDSQELSACAPLTVVCDGCFSNLRRSLCNPKVDVPSHFVGLILESCELPYANHGHVILGDPSPVLFYRISSSEIRCLVDVPGQKVPSISNGEMTNYLKTVVAPQIPPELHDSFVAAVDKGNIRTMPNRSMPAAPYPTPGALLMGDAFNMRHPLTGGGMTVALSDIVVLRNLLRPLRDLNDAPGLCKYLESFYTLRKPVASTINTLAGALYKVFCASPDPARKEMRQACFDYLSLGGLFSEGPVSLLSGLNPRPLSLVLHFFAVAIYGVGRLLLPFPSPKRMWIGVRLISSASGIILPIIKAEGVRQMFFPATVPAYYRNPPAQ

SEQ ID NO: 5798 - protein, 519 aa, Triphysaria pusilla
MIDQYSFGCFVASLFAFALLYNLGRKVRRTKGLKAVRGDECITRSAVRGEAGGDADIIIVGAGVAGAALAYTLGKEGHRVRVIERDLTEPDRIVGELLQPGGYLKLVELDLEDCVGNIDAQRVFGYALYKDGKNTKLSYPLDKFHSDVSGRSFHNGRFIQRMREKAATLPNVKLEQGTVTTLLEENGTVKGVNYKTKNGEEIAAHAPLTIVCDGCFSNLRRALCTPQVENPSCFVGLIIENCELPHANHGHVILGDPSPILLYPISSTEIRCLVDVPGQKVPSIANGEMANYLKTVVAPQIPRELYNGFIAAVEKGNIRTMPNRSMPANPQPTPGALLMGDAFNMRHPLTGGGMTVALSDIVVLRDLLRPIQDLNDTSTLCNYLESFYTLRKPVASTINTLAGALYKVFCASPDPASKEMRQACFDYLSLGGICSDGPIALLSGLNPRPLSLFLHFFAVAIYGVGRLLLPFPSPQRVWLGVRLLLGASGIIFPIIKAEGVRQMFFPATVPAYYRAPPAN

SEQ ID NO: 5799 - protein, 476 aa, Cajanus cajan
MHSSNRRGDGDVDVIIVGAGVAGSALAHTLGKDGRRVLVIERDLSEPDRIVGELLQPGGYLKLIELGLEDCVEKIDAQQVFGYALFKDGKHTRLSYPLDKFHSNVTGRSFHNGRFIQRMREKAASLPNVRLEQGTVTSLLEEKGIIKGVLYKTKDSKELSACAPLTIVCDGCFSNLRRSLCNPKVDVPSCFVGLVLENCELPCANHGHVILGDPSPVLFYPISSTEIRCLVDVPGQKVPSISNGEMENYLKTVVAPQVPSELHDAFIAAVDKGNIRTMPNRSMPAAPYPTPGALLMGDAFNMRHPLTGGGMTVALSDIVVLRNLLRPLRDLNDASSLCKYLESFYTLRKPVASTINTLAGALYKVFCASPDPARKEMRQACFDYLSLGGLFSEGPVSLLSGLNPRPLSLVLHFFAVAIYGVGRLLLPFPSPKRIWIGVRLISSASGIILPIIKAEGVRQMFFPATVPAYYRNPPAS

SEQ ID NO: 5800 - protein, 526 aa, Glycine max
MADLSVLGWILCSALSLFALYSLAFGGASRNRASPEKRNELSETVTTSAGECRSEKHHGDADVIIVGAGVAGASLAHTLGKDGRRVHVIERDLSEPDRIVGELLQPGGYLKLIELGLEDCVDKIDAQQVFGYALFKDGKHTRLSYPLEKFHSDVSGRSFHNGRFIQRLREKAASLANVRLEQGTVTSLVEEKGTIKGVQYKNKDGQELTTYAPLTIVCDGCFSNLRRSLCNPKVDIPSCFVGLVLENCELPCANHGHVILGDPSPILFYPISSTEIRCLVDVPGQKVPSISNGEMEKYLKTMVAPQIPPQLYDAFIAAVDKGNIRTMPNRSMPADPHPTPGALLMGDAFNMRHPLTGGGMTVALSDIVVLRNLLSPLSDLNDAPTLCKYLESFYTLRKPVASTINTLAGALYKVFCASPDLARKEMRQACFDYLSLGGLFSEGPVSLLSGLNPRPLSLVLHFFAVAIYGVGRLLLPFPSPKRVWIGARLISGASAIILPIIKAEGIRQMFFPATVPAYYRTPPVAQ

SEQ ID NO: 5801 - protein, 533 aa, Flaveria ramosissima
MELESPTLIHQINDHLLPYAVALLFAFISLYILRSNLKTPRKPKDIAPKCHTNSGDHGILQLPETDGSADVIIVGAGVAGAALACTLAKDGRRVHVIERDLTEPDRIVGELLQPGGYLKLIELGLEDCVDGIEAQQVFGYAIYMDNRNTKLSYPLEKFESDISGRSFHNGRFIQRMREKAASLPNVKLEQGTVTSLLEEDGTVKGVNYKTKDGQVMTARAPLTIVCDGCFSNLRRALCKPKVEVPSCFVGLVLENIDLPYANHGHVILADPSPILFYPISNTEVRCLVDVPGQKVPSIANGEMANYLKTVVAPQIPPELYDAFVAAVDKGNIRTMPNRSMPADPQPTPGALLMGDAFNMRHPLTGGGMTVALSDIVLLRDLLRPLSNLNDATTLCNYLECFYTLRKPVSSTINTLAGALYKVFCASPDPARKEMREACFDYLSLGGICSQGPISLLSGLNPRPLVLFLHFFAVAIYGVGRLLIPFPSPKRLWLGARLISGASGIIFPIIKSEGVRQMFFPATVPAYYKAPHVT

SEQ ID NO: 5802 - protein, 255 aa, Brassica napus
MMEPQLLGWLSPLVISFVLVTSVFAFYALFVKPRRNSNKLDSTTSKIHHDRTVTSTVGSLNVSVGDTVSDVIVVGAGVAGSALAYTLGKDNRRVHVIERDLSEPDRIVGELLQPGGYLKLLELGIEDCVEEIDAQRVYGYALFKNGKRIRLAYPLEKFHTDVSGRSFHNGRFIQRMREKAASLPNVQLEQGTVVSLLEENGTIKGVRYKNKAGEESTAFAALTIVCDGCFSNLRRSLCNPQVDVPSCFVGLVLEN

SEQ ID NO: 5803 - protein, 528 aa, Phaseolus vulgaris
MVDPYVLGWILCSVLTLFALYSLAFSGESRRRASPKAEKSIELSETVTTSTSECRSEKRDADVDVIIVGAGVAGAALAHTLGKDGRRVHVIERDLSEPDRIVGELLQPGGYLKLIELGLEDCVDKIDAQQVFGYALFKDGKHTRLAYPLEKFHSDISGRSFHNGRFIQRMREKASTLPNVRLEQGTVTSLVEEKGTIKGVQYKNKDGQELTTFAPLTIVCDGCFSNLRRSLCNPKVDVPSCFVGLLLENCELPCANHGHVILGDPSPILFYRISSTEIRCLVDVPGKKVPSISNGEMEKYLKTTVAPQIPPELYDAFIAAVDKGNIRTMPNRSMPADPLPTPGALLMGDAFNMRHPLTGGGMTVALSDIVVLRNLLRPLPDLNDAPTLCKYLESFYTLRKPVASTINTLAGALYKVFCASPDQARKEMRQACFDYLSLGGLFSEGPVSLLSGLNPRPLSLVLHFFAVAIYGVGRLLLPFPSPKRVWIGARLISGASGIIFPIIKAEGIRQMFFPVTVPAYYRTPPVGQ

SEQ ID NO: 5804 - protein, 522 aa, Eucalyptus grandis
MDGQYLVSGVLALFLGIFLLYKGLGKQKRRLSKKGRGDDYVKSSVDGGFVPGGVDGSTDIVIVGAGVAGAALAYALGKDGRRVRVIERDLTEQDRIVGELLQPGGYLKLMELDLADCVQTIDAQRVVGYALFKDGKHTQLSYPLENFHSDVAGRGFHNGRFVQSMREKAATLPNVSLEQGTVTSLIEEKGTVKGVQYKTKAGEELKAYAPLTIVCDGCFSNLRRNLCFPKVDVPSHFVGLVVENCDLPFPNHGHVILADPSPILFYPISSTEIRCLVDVPGQKLPSLASGEMATYLKTKVAPQVPPQLYKAFIAAIDKGNIKSMPNRSMPANPQPTPGALLMGDAFNMRHPLTGGGMTVALSDIVLLRNLLRPLQDLNDASALCKYLESFYTLRKPVASTINTLAGALYKVFCASPDPARKEMRQACFDYLSLGGLCSTGPVSLLSGLNPRPMHLVCHFFAVAVYGVGRLCLPFPSPKRMWLGARLVKGASGIIFPIIRDEGVRQMFFPATVPAYHRAPPVH

SEQ ID NO: 5805 - protein, 358 aa, Plantago ovata
MREKASTLSNVRLEQGTVTSLIEEKGTVKGVQYKTKDGEEISAFAPLTIVCDGCFSNLRRSLCTPKVENPSCFVGLILENCELPYANHGHVVLGDPSPILFYPISSTEIRCLVDVPGQKVPSIGNGEMANYLKTVVAPQVPPQLYDSFIATVEKGNIRTMPNRSMPANPQPTPGALLMGDAFNMRHPLTGGGMTVALSDIVILRDLLRPIRDLHDAPVLSNYLESFYTLRKPVSSTINTLAGALYKVFCASPDPARKEMRQACFDYLSLGGVCSTGPVALLSGLNPRPLSLVSHFFAVAVFGVGRLLLPFPSPKRVWLGARLLMGASGIILPIIKAEGVRQMFFPATVPAVYRAPPVN

SEQ ID NO: 5806 - protein, 523 aa, Zostera marina
MEMLPLMQYLFAGIVAVLVGFFFLFWRKTKTKTKNGIPPKKVENEKRSSVKTDDQDGNYDVIIVGAGVAGSALAYTLGKDGRRVRVIERDLSEPDRIVGELLQPGGYLKLVELDLEDCVEEIDAQRVNGYALFKDGRNTKVAYPLEQFDSDVAGRSFHNGRFIQRLRGKAASLPNVLLEEGTVKSLLEENGSVKGVLYKTKTCEEIKVYAPLTIVCDGCFSNLRRSLCSPKVDVPSCFVGLVLENCELPYPNHGHVILADPSPILFYPISSTEVRCLVDVPGEKVPSVANGEMAKYLKTVVAPQLPPEIQIPFLATVEKGNMRSMPNKSMPAAPYPTPGALLMGDAFNMRHPLTGGGMTVALSDIAVLKNLLKPLRDLNDTSSLCKYLESFYTLRKPVASTINTLAGALYKVFCASPDQAMKEMREACFDYLSLGGAFSNGPVALLSGLNPRPLSLVCHFFAVAIYGVGRLLIPFPSPKRIWIGARLISGASNIIFPIIRAEGIRQMFFPATVPAYYRAPPVN

SEQ ID NO: 5807 - protein, 531 aa, Euphorbia peplus
MEVIFDTYIFGTFFASLCAFLLLFILRPKVKKMGKIREISSINTQNDTAITPPKGSGTDVIIVGAGVAGAALACTLGKDGRRVHVIERDLKEPDRIVGELLQPGGYLKLVELGLQDCVEEIDAQRIVGYALFMDGNNTKLSYPLEKFDAEVSGKSFHNGRFIQRMREKAASLPNVQLEQGTVTSLLEENGTIKGVQYKTKDGQEHKAYAPLTVVCDGCFSNLRRSLCKPKVDVPSHFVGLVLENCDLPFANHGHVILADPSPILFYPISSTEVRCLVDVPGQKLPSIASGEMAKYLKTMVAKQIPPVLHDAFVSAIDKGNIRTMPNRSMPADPLPTPGALLMGDAFNMRHPLTGGGMTVALADIVLLRDLLKPLRDLNDAPALAKYLESFYTLRKPVASTINTLAGALYKVFSASPDEARKEMRQACFDYLSLGGECAMGPVSLLSGLNPSPLTLVLHFFGVAIYGVGRLLIPFPTPKGMWIGARIISSASGIIFPIIKAEGVRQVFFPATVPAIYRNPPVNGKSVEVPKS

SEQ ID NO: 5808 - protein, 299 aa, Arabidopsis lyrata
MAGTCTSIRPRLIGSSSIVELSRLINRAGVPFSVRISTRTRALHGGGLTAPTSREEGPSCIFVGPIDSARKETLEALYRQAKDAYYNGKPLIVDDMFDRVELKLRWYGSKSVVKYPRCSLLRQSTYADAEDDASQVLLLATIWILIFLFGSSACVLPTMYGLGLVYGGDPVDSGLVYSGQLSSSVPLLSKFNGILLAVLGPAFGYPIASSAVRVLKGLWRNDLTALKGDCPNCGEEVFAFVRSDQSNRSAHKADCHVCECTLEFRTKVEKSTSRLGRKWVYGRIYLVSRPRRDRRSKFT

SEQ ID NO: 5809 - protein, 301 aa, Eutrema halophilum
MAGTCTSIRPRLLGSCSIAELSRLINRAGVPFSVRISTRRSRTRGHGGGFTARTLREEGPSCIFVGPIDSARKETLEALYRQARDAYYNGKPLIVDDMFDRVELKLRWYGSKSVVKYPRCSLLRQSTYADAEDDASQVLLLATIWILILLFGSSACVLPAMYGLGLVYGGDPFDSGLVYTGQLSSSVPLLSKFNGILLTVLGPAFGYPIASSAMRVLEGLWRNDLTALKGDCPNCGEEVFAFVRSDQSNRSAHKADCHVCECTLEFRTKVEKSVSPLGRKWVYGRIYLVSRPRRNRRSKYT

SEQ ID NO: 5810 - protein, 302 aa, Brassica rapa
MAGTCSSIRPPRLIGSCSSLELSRLIDRAGVPFSVRISTRRKSITRSQGGGFTAPVSSREEGPSCIFVGPIDSARKETLEALYRQAKNAYYNGKPLIVDDMFDRVELKLRWYGSKSVVKYPRCSLLRQSTYADAEDDASQVLLLGTIWILILLFGSSACVLPTIYGLGLVYGGDPFNSGLVYSSSTSVPLLSKLNGILLTVLGPAFGYPIASSAVRVLKGLWRNDLTALKGDCPNCGEEVFAFVRSDQSNKSAHKADCHVCECTLEFRTKVEKSASLLGRKWVYGRIYLVSRPRRGRRSKYT

SEQ ID NO: 5811 - protein, 302 aa, Brassica napus
MAGTCSSIRPPRFIGSCSSLELSRLIDRAGVPFSVRISTRRKSITRSQGGGFTAPVSSREEGPSCIFVGPIDSARKETLEALYRQAKNAYYNGKPLIVDDMFDRVELKLRWYGSKSVVKYPRCSLLRQSTYADAEDDASQVLLLATIWILILLFGSSACVLPTIYGIGLVYGGHPFESGLVYSSSSSVPLLSKLNGILLTVLGPAFGYPIASSAVRVLKGLWRNDLTALKGDCPNCGEEVFAFVRSDQSNKSAHKADCHVCECTLEFRTKVEKSASLLGRKWVYGRIYLVSRPRRGRRSKYT

SEQ ID NO: 5812 - protein, 302 aa, Brassica napus
MAGTCSSIRPPRFIGSCSSLELSRLIDRAGVPFSVRISTRRKSITRSQGGGFTAPVSSREEGPSCIFVGPIDSARKETLEALYRQAKNAYYNGKPLIVDDMFDRVELKLRWYGSKSVVKYPRCSLLRQSTYADAEDDASQVLLLATIWILILLFGSSACVLPTIYGIGLVYGGDPFKSGLVYSSSSSVPLLSKLNGILLTVLGPAFGYPIASSAVRVLKGLWRNDLTALKGDCPNCGEEVFAFVRSDQSNKSAHKAECHVCECTLEFRTKVEKSASLLGRKWVYGRIYLVSRPRRGRRSKYT

SEQ ID NO: 5813 - protein, 325 aa, Raphanus sativus
  misc_feature (104)..(104): Xaa can be any naturally occurring amino acid
  misc_feature (261)..(261): Xaa can be any naturally occurring amino acid
  misc_feature (271)..(271): Xaa can be any naturally occurring amino acid
MAGTCSSIRPRIIGASSTVKLSRLINGAGVPFSVRISTRTRSHGGGFTASISSSREEGPSCIFVGPIDSARKETLEALYRQAKNAYYNGKPLIVDDMFDRVELXLRWYGSKSVVKYPRCSLLRQSTYADAEDDASQVLLLATIWILILLFGSSACVFPSMYGLGLVYGGDPFDSGLFYSSSSSSVPLLTKLNGILLTVLGPAFGYPIASSAVRVLKGLWRNDLTALKGDCPNCGEEVFAFVRSDQSNRSAHKADCHVCECXLEFRTKVEKXASLLGRKWVYGRIYLVSRPREVGVPSIHSSDKDKNFGECFYSIVYLFLKKVTRS

SEQ ID NO: 5814 - protein, 301 aa, Hordeum vulgare
MGDLGVRVVGRGCAAPMEPRKEMAPPPPMEQHHPPLFMDFSRRDGVADGGNVRKRPREAVAPPARLFSLQAPQGSPAHKVIHLAQLHRRPAATGLRLDFDEGGSEHVACTSSSPSSVLPGELAAQCGQYSNEIDRLLQEHAERLRLALADTRRRQNRSLLGAAEALAARRVREMEAETFKAARRGVELEEQLARLRAEAASWQAKAMSDQSTAAALHAQLQQAAATAQARSGKAALDDDGAAGAADDAESGFVDPDRVVEVIAPPPAARPCRACRLRPASTVLLPCRHLCVCDACDPGVPA

SEQ ID NO: 5815 - protein, 449 aa, Triticum aestivum
QGVHADAAVRWVVHVGKAGHDGEADVAITIHGRERGKEEPAKAESPRPRHPDKTRGTVEQLSRVAFALPTPRRNSLIHRIPAPPTAIPSNSSSPRTRFAPQIARTGQWQRRGPVAAAATGNRASSSSPPARRPRRCCCFSRPRLPLRGDRSPGRMGDLGVRVVGRGCAAPMEPRKEMVAPSLEQQGQQQHPPLFMDFSRRDGVADGGNGRKRPRETVAPPARLFSLQAPQGSPGHKVIHLAQLHRRPAATGLRLDFDEGGSEHVACTSSTSSLLPGELAAQCGRHNNEIDRLLQEHAERLRLALADTRRRQNRSLLGAAEALAARRVREVEAETFKAARRGVELEERLARLRAEAASWQAKAMSDQSTAAALHAQLQQEAATAQARSGKAAEEAEGAADDAESGFIDPDRVVEVAAPPPARPCRACRLRPATTVLLPCRHLCVCAACDP

SEQ ID NO: 5816 - protein, 98 aa, Secale cereale
MWEHRLRAAAAVAFLAVAVVSISAVGPRLGAVVSFFWPLLVSTGFFLVAITVLLRISPPPSGAEESGKEIIDFVAGCRPEHLLPEASAAVEVPPEPEI

SEQ ID NO: 5817 - protein, 508 aa, Secale cereale
SLYWLVELLSLLCFFVFYYRHLQSKKISKAEPTEWPILGHLFGMVANLSRFHDWATGILAGTRYNFEARAGITGVRFFVTCDPANVRHIFTSNFTNYPKGEEFADIFDVFGDGIFNADGDSWRRQRAKSQLIMAGPRFRAFSARYSRDKVERSLLPFLAHAADAGTRTPCDLHDVFLRLTFDMTCNLVFGVDPGCLQIGLPVVPFARAMDDVLETLFLRHIISPKCWKLMYRYELGTERKMAAGRRTIDRFAADTIAKRRADHKLRDDGVSDSSDMLSSFICNGEYSDDFLRDTTVNLLLAGRDTTGAALSWFFYLISKNPRVEQKILDELAPIASRKKKNLDGMVVLDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNFAVEAVPGHVVEPKLSIILHMKNGLAVTVKRRNAAPVHG

SEQ ID NO: 5818 - protein, 505 aa, Triticum aestivum
VELLTVLCFVVFYYRHLQSKKISKAEPTEWPILGHLLGMVANLSHFHDWATGILAGTRYNFQARAGITGVRFFVTCDPANVRHIFTSNFTNYPKGDEFAEIFDVFGDGIFNADGESWRRQRAKSQLIMAGPRFRAFSARYSRDKVERSLLPFLAHAAEAGSTPCDLHDVFLRLTFDMTCNLVFGVDPGCLQIGLPVVPFARAMDDVLETLFLRHIISPACWKLMYRYEVGTERKMAAARRTIDRFAADTITKRRVDHKLRPNEGVTDSSDMLSSFICNGDASEYSDEFLRDTTVNLLLAGRDTTGAALSWFFYLLSKNPSVEQRILDELAPIASRKKKLDGMVVFDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNFAVEAVPGHVVEPKLSIILHMKNGLAVTVKRRNVAGVHG

SEQ ID NO: 5819 - protein, 499 aa, Triticum aestivum
LCFVVFYYRHLQSKKISKAEPTEWPILGHLLGMVANLSHFHDWATGILAGTRYNFQARAGITGVRFFVTCDPANVRHIFTSNFTNYPKGDEFAEIFDVFGDGIFNADGESWRRQRAKSQLIMAGPRFRAFSARYSRDKVERSLLPFLAHAAEAGSTPCDLHDVFLRLTFDMTCNLVFGVDPGCLQIGLPVVPFARAMDDVLETLFLRHIISPACWKLMYRYEVGTERKMAAARRTIDRFAADTITKRRVDHKLRPNEGVTDSSDMLSSFICNGDASEYSDEFLRDTTVNLLLAGRDTTGAALSWFFYLLSKNPSVEQRILDELAPIASRKKKLDGMVVFDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNFAVEAVPGHVVEPKLSIILHMKNGLAVTVKRRNVAGVHG

SEQ ID NO: 5820 - protein, 485 aa, Secale cereale
ISKAEPTEWPILGHLFGMVANLSHFHDWATGILAGTHYNFEARAGITGVRFFVTCDPANVRHIFTSNFTNYPKGEEFAEIFDVFGDGIFNADGESWRRQRAKSQLIMAGPRFRAFSARYSRDKVERSLLPFLAHAADAGTRNPCDLHDVFLRLTFDMTCNLVFGVDPGCLQIGLPVVPFARAMDDVLETLFLRHIISPKCWKLMYRYELGTERKMAAGRRTIDRFAADTIAKRRADHKLRDDGVSDSSDMLSSFICNGDASEYSDEFLRDTTVNLLLAGRDTTGAALSWFFYLISKNPRVEQKILDELAPIASPKKKNLDGMVVFDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNFAVEAVPGHVVEPKLSIILHMKNGLAVTVKRRNAAPVHG

SEQ ID NO: 5821 - protein, 477 aa, Secale cereale
WPILGHLFGMVANLSRFHDWATGILAGTHYNFEARAGITGVRFFVTCDPANVRHIFTSNFTNYPKGEEFAEIFDVFGDGIFNADGESWRRQRAKSQLIMAGPRFRAFSARYSRDKVERSLLPFLAHAADAGTRTPCDLHDVFLRLTFDMTCNLVFGVDPGCLQIGLPVVPFARAMDDVLETLFLRHIISPKCWKLMYRYELGTERKMAAGRRTIDRFAADTIAKRRADHKLRDDGISDSSDMLSSFICNGDASEYSDEFLRDTTVNLLLAGRDTTGAALSWFFYLISKNPRVEQKILDELAPIASPKKKNLDGMVVFDVSELSGMVYLHAALCECLRLYPSVPFEHKAAVADDVLPSGHEMKAGDKILIFSYCMARMEGVWGKDCMEFRPERWVTADGKLRYEPSYKFISFNAGPRTCLGKEMAFVQMKTAAAAVLWNFAVEAVPGHVVEPKLSIILHMKNGLAVTVKRRNAAPVHG

SEQ ID NO: 5822 - protein, 506 aa, Brachypodium distachyon
MAPTVGLKRSGTTQTIAVPPPPQDARFAVREAVRSTIATPPPAEAPGAPARVAPAPALEGFLCLEEVDGRRWKYVVDEAPGKGKGGRGGSAVPLGASVRAVPLQSPLPPAEEIMAFVRSYVVPEGFPDSVTPSYVPYMTWRALKHFFGGAMGVFTTRTLLSSVGVSQSKVTPGAIAINWILKDGAGRVGKMLFARQGKKFDNDLKQLRFSSDLLLEIGAGIELATAAFPQFFLPMACVANVVKNVAAVTSTSTRTPIYKAYARGENIGDVTAKGESVGNIADLLGTGLSIYITKRNPSLVTSFALLSCGYLMSSYQEVRSVVLNTLNRARFTVAVDSFIKTGYVPSLKEGNSQETLFIHPWRHEPVAIGSRFGEAFQEPVSFVATRPLFEDERYMVTYNPTKDKVYALLKDQAKPDDVLKAAFHAHVLLHFINASHARKRMNTNRSDHYANLHPRNMDFLAHIAESCKLVSASYGTFKKKAREQGWIMSESLLNPGKARLCVRGLQ

SEQ ID NO: 5823 - protein, 508 aa, Oryza sativa
MAPTVGIKRSAAAVATQTISVPPPDARFAVREAVRATIASPPVEAPPAAAGKAAAPAPAVEGFLCLEEVDGRRWSYVVDGGQGKGKGRGRGRSGAAVPMGASVRAVPLQSPLPPAEEVMAFIRSYVVPEGFPDSVTPSYVPYMTWRALKHFFGGAMGVFTTRTLLSSVGVSQSKVTPGAIAINWILKDGAGRVGKMLFARQGKKFDYDLKQLRFSSDLLLEIGAGIELATAAFPQFFLPMACVANVVKNVAAVTSTSTRTPIYKAYARGENIGDVTAKGESVGNIADLLGTGLSIFISKRNPSLVTSFAFLSCGYLWSSYHEVRSVVLNTLNRARFTVAVDSFIKTGHIPSLKEGNSQETIFNPPWRHEPVAIGSRFGEAFQEPASFVAIRPLFEDERYMVTYNPAKDKVYALLKDQAKSDDIIKAAFHAHVLLHFINASHARKQMNSRRSDPYGNPCNMDFMAHIAESCKIVSSSYGTFKKKAREQGWIMSESLLNPGKARLCPARP

SEQ ID NO: 5824 - protein, 503 aa, Zea mays
MAPAVGLKRSATQTITLPPPDTRLAVRDVMRSTIPSQPAVAPASTERQAPAAALQGFLCLEEVDGRRWSYVVDGGAAKGRSRGGAVPAGAAVRAVPLQSPLPPAEEIMAFIRSYVVPEGFPDSVTPSYVPYMTWRALKHFFGGAMGVFTTRTLLSSVGVSQSKVTPGAIAINWILKDGAGRVGKMLFARQGKKFDYDLKQLRFSSDLLLEIGAGIELTTAAFPQFFLPMACVANVVKNVAAVTSTSTRTPIYKAYARGENIGDVTAKGESVGNIADLLGTGLSIFISKRNPSLVTSFAFLSCGYLLSSYQEVRSVVLNTLNRARFTVAVDSFIKTGHIPSLKEGNSQETIFNPPWRHEPVAIGSRFGEAFQEPASFLAIRPLFEDERYMVTYNPTKDKVYALLKDQAKSDDIIKAAFHAHVLLHFINASHARRLKQKQKQANPDRSEYLYSRNMDFLAHIAESCKIVSSSYGTFKKKAREQGWIMSESLLNPGKARLCAAKPQ

SEQ ID NO: 5825 - protein, 509 aa, Setaria italica
MAPAVGIKRSTTQAVTLPPPDARLAVRDVLRSTIPSQPAEAPPAAERPAAPAAAVEGFLCLEEVDGRRWSYVVDRGAVKGRGRAGAASPAGASVRAVPLQSPLPPAEEIMAFIRSYVVPEGFPDSVTPSYVPYMTWRALKHFFGGAMGVFTTRTLLSSVGVSQSKSTPGAIAINWILKDGAGRVGKMLFARQGKKFDYDLKQLRFSSDLLLEIGAGIELTTAAFPQFFLPMACVANVVKNVAAVTSTSTRTPIYKAYARGENIGDVTAKGESVGNIADLLGTGLSIFISKRNPSLVTSFAFLSCGYLLSSYHEVRSVVLNTLNRARFTVAVDSFIKTGHIPSLKEGNSQETIFNPPWRHEPVAIGSRFGEAFQEPASFVAIRPLFEDERYMVTYNPTKDKVYALLKDQAKSDDIIKAAFHAHVLLHFINASHARRLKQKQKQKQANPDRSDYGNLYSRNMDFLAHIAESCKIVSSSYGTFKKKAREQGWIMSESLLNPGKARLCGAKPL

SEQ ID NO: 5826 - protein, 154 aa, Sorghum bicolor
MAPAVGLKRSATQTITLPPPETRLAVRDVMRSTIPSQPAEAPASTERPAPAAALQGFLCLEEVDGRRWSYVVDGGAAKGRGRGGAAVPAGASVRAVPLQSPLPPAEEIMAFIRSYVVPEGFPDSVTPSYVPYMTWRALKHFFGGAMGVLQQEPC

SEQ ID NO: 5827 - protein, 517 aa, Sorghum bicolor
MAPAVGLKRSATQTITLPPPETRLAVRDVMRSTIPSQPAEAPASTERPAPAAALQGFLCLEEVDGRRWSYVVDGGAAKGRGRGGAAVPAGASVRAVPLQSPLPPAEEIMAFIRSYVVPEGFPDSVTPSYVPYMTWRALKVFCGTYVQQSAFTALLWWSDGGVTTRTLLSSVGVSQSKVTPGAIAINWILKDGAGRVGKMLFARQGKKFDYDLKQLRYTSDLLLEIGAGIELTTAAFPQFFLPMACVANVVKNVAAVTSTSTRTPIYKAYARGENIGDVTAKGESVGNIADLLGTGLSIFISKRNPSLVTSFAFLSCGYLLSSYQEVRSVVLNTLNRARFTVAVDSFIKTGHIPSLKEGNSQETIFNPPWRHEPVAIGSRFGEAFQEPASFLAIRPLFEDERYMVTYNPTKDKVYALLKDQAKSDDIIKAAFHAHVLLHFINASHARRLKQKQKQANPDRSEHLYSRNMDFLAHIAESCKIVSSSYGTFKKKAREQGWIMSESLLNPGKARLCAAKPQ

SEQ ID NO: 5828 - protein, 469 aa, Pennisetum glaucum
PQQPAEAPPPPAAERPAAPPAAVEGFLCLEEVDGRRWSYVVDRGAAKGRGRGASAGASVRAVPLQSPLPPAEEIMAFIRSYVVPEGFPDSVTPSYVPYMSWRALKHFFGGAMGVFTTRTLLSSVGVSQSKATPGAIAINWILKDGAGRVGKMLFARQGKKFDYDLKQLRFSSDLLLEIGAGIELTTAAFPQFFLPMACVANVVKNVAAVTSTSTRTPIYKAYARGENIGDVTAKGESVGNIADLLGTGLSIFISKRNPSLVTSFALLSCGYLLSSYQEVRSVVLNTLNRARFTVAVDSFIKTGHIPSLKEGNSQETIFNPPWRHEPVAIGTRFGEAFQEPASFVAIRPLFEDERYIVTYNPTKDKVYALLKDQAKSDDIIKAAFHAHVLLHFINASHARRLKQKRKQANPDYGNLYSRNMDFLAHIAESCKIVSSSYGTFKKKAREQGWIMSESLLNPGKARLCGGKPQ

SEQ ID NO: 5829 - protein, 269 aa, Panicum virgatum
MSPTPSQLAGGEPFRVFVGYDSREDIAYRVCRRSLLRRSSIPVDVIPIVQQELREAGLYWRERGPTESTEFSFTRFLTPHLAGYRGWALFVDCDFLFVADVAELARLADPRYAVLCVHHDYTPREATKMDGAVQTAYPRKNWSSMVLFNCGHPKNRAALTPEAVSTQTGAYLHRFMWLDDGEVGEVPFVWNFLVGHNKVDPADEAGTAPRAIHYTSGGPWFERYKDCEFADLWVQERDAYEAEEKEEKVAEDDDVKAAIPMAPAVSVDA

SEQ ID NO: 5830 - protein, 280 aa, Brachypodium distachyon
MSPPAQAPTNNLTGAGAGTDEPFRVFVGYDSREDIAYRVCRRSLLRRSSIPLEIIPIVQDELRSAGLYWRERGPTESTEFSFTRFLTPHLAGYRGWALFIDCDFLFVADVAELARMCAAANPRHAVLCVHHDYAPKEATKMDGAVQTLYPRKNWSSMVLFNCGHPKNRAALTPDEVSTRSGAHLHRFAWLDDDEVGEVPFVWNFLVGHNRVDPDDVAGTTPRAIHYTSGGPWFERYKDCEFADLWIQERDAYESEEKQAEEVNKPMAAAPVPSPAVSVDA

SEQ ID NO: 5831 - protein, 279 aa, Brachypodium distachyon
MSPPPAAPTNLTGAGAGTEEPFRVFVGYDSREDIAYRVCRRSLLRRSSIPLEIIPIVQDELRSAGLYWREREPTESTEFSFTRFLTPHLAGYRGWALFIDCDFLFVADVAELARMCAAAKPRHAVLCVHHDYAPKEATKMDGAVQTLYPRKNWSSMVLFNCGHPKNRAALTPDEVSTRSGAHLHRFAWLDDDEVGEVPFVWNFLVGHNRVDPDDVAGTTPRAIHYTSGGPWFERYKDCEFADLWIQERDAYEAEEKQDDDVAKPMAAAPVPSPAVSVDA

SEQ ID NO: 5832 - protein, 271 aa, Panicum virgatum
MSPTASQLAGGEPFRVFVGYDSREDIAYRVCRRSLLRRSSIPLDVIPIVQQELREAGLYWRERGPTESTEFSFTRFLTPHLAGYRGWALFVDCDFLFVADVAELARLADPRYAVLCVHHDYVPREATKMDGAAQTVYPRKNWSSMVLFNCGHPKNRAALTPEAVSTQTGAYLHRFMWLDDGEVGEVPFVWNFLVGHNKVDPADEAGTAPRAIHYTSGGPWFERYKDCEFADLWVQERDAYEAEEEKEKQAADEDDVKAGAIQMAPAVSVDA

SEQ ID NO: 5833 - protein, 281 aa, Oryza sativa
MSVTPTDDVMMTGAGDVQAAETFRVFVGYDSREDIAYRVCRRSLLQRSSVPVAVIPIVQQELRSAGLYWRERGPTESTEFSFTRFLTPHLAGYRGWALFVDCDFLFVADVAELARMADPRYAVLCVHHDYAPKEATKMDGAVQTVYPRKNWSSMVLFNCAHPKNRAALTPEAVSTQSGAYLHRFMWLDDADIGEVPFVWNFLVGHNRVDPADTAGTAPRAIHYTSGGPWFEQYKNCEFAELWVQERDAYEAEAEEDEEKEEHEAKAILHAPAAPSAVSVDA

SEQ ID NO: 5834 - protein, 86 aa, Triticum aestivum
MMWGVAAAVASAAAVAVASVAELLACDCAPTEPAAAVAVAVGRCDEFLLRQRESPASSGGSGGRDDKFAPRFDGLRFIETLVTAHR

SEQ ID NO: 5835 - protein, 430 aa, Secale cereale
MGISSKWIKSLVGIKKHGKAQNGESSRERSSAAQVLHKRKHSVDTEGALAVAEHIVQTEPLASDANTQTISSQTGLNAKEHQAATVIQSAFRAFLARRALRALKGLVRLQALVRGHAVRKQAAETLQCMQSLVKAQARVRARQVRIGLEGQVTQKKAPEKNPHEDPAREIEERWCGGIGSAEDMQAKVLKKQEAAAKRERAMAYALTHQRQAGSRKLKAADVQGPEADENQWGRNWVERWVAVRPWENRLLDGNAKENVPIGDDKEAEENGDRDANKPKGKAAVSGIQSNGSSQTKDAKHKKSHSDASGSSSGQSAAAPPTASLGSSKLKPKPSDETSEEVSPQPTDPAPRSPSNPKERPAAQVSAPTKKRLSLPNNATASGGARKGQASSSEKTRSVGSKNTAKGASKSEPKQRQSPGSATAKRVQAQA

SEQ ID NO: 5836 - protein, 430 aa, Secale cereale
MGISSKWIKSLVGIKKHGKAQNGESSRERSSAAQVLHKRKHSVDTEGALAVAEHTVQTEPLASDTNTQTISSHTELNAKEHQAATVIQSAFRAFLARRALRALKGLVRLQALVRGHAVRKQAAETLQCMQSLVKAQARVRARQVRIGLEGQVTQKKAPEKNPHEDPAREIEERWCGGIGSAEDMQAKVLKKQEAAAKRERAMAYALTHQRQAGSRKLKAADVQGPEADENQWGRNWVERWVAVRPWENRLLEGNAKENVPIGDDKEAEENGDRDANKPKGKAAVSGIQSNGSSQTKDAKHKKSHSDASGSSSGQSAAVPPAASLGSSKLKPKPSDQTSEEVSPQPTDPAPRSTSNPKERPAAQVNAPTKKRLSLPNNATASGGARKGQASSSEKTRSVGSRNTAKGASKSEPKQRQSPGSATPKRVQSQA

SEQ ID NO: 5837 - protein, 188 aa, Triticum aestivum
MGISSKWIKSLVGIKKHGKAQNGESSRERSSAAQVLHKRKHSVDTEGALAVAERTVQTEPLASDTNTQTISSETELNTKEHQAATVIQSAFRAFLARRALRALKGLVRLQALVRGHAVRKQAAETLQCMQSLVKAQARVRARQVCIGLEGQVPQKKAPEKMLRRIKLEKLRNAGVAVLDRRKICKLKY

SEQ ID NO: 5838 - protein, 426 aa, Triticum aestivum
MGISSKWIKSLVGIKKHGKAQNGESSRERSSAAQVLHKRKHSVDTEGALAVAEHRVQTEPLASDTNTQTISSETELNTKEHQAATIIQSAFRAFLARRALRALKGLVRLQALVRGHAVRKQAAETLQCMQSLVKAQARVRARQVRIGLEGQVPQKKAPEQNAQEDQAREIEERWCGGIGSAEEMQAKVLKKQEAAAKRERAMAYALTHQRQAGSRKQKAADVQGPEADENQWGRNWVERWVAVRPWENRLLDSNAKENVPIGDDKEAEENGDRDVNKPKGKVAVSGIQLNGSSQTKDAKHKKSHSDASGSSSGQSAAAPPAASLGSSKLKPKPSDQTSEEVSPQPTDPAPRSTSNPKERPAAQVNAPTKKRLSLPNNAAAGGAARKGQANSSEKAQPVGSKNKAKGASKSESKQRPSPGSTSAKRV

SEQ ID NO: 5839 - protein, 430 aa, Triticum aestivum
MGISSKWIKSLVGIKKHGKAQNGESSRERSSAAQLLHKRKHSVDTEGSLAVAEHTVQIEPLASDTNTQTISSETELNTKEHQAATVIQSAFRAFLARRALRALKGLVRLQALVRGHAVRKQAAETLQCMQSLVKAQARVRARQVRIGLEGQVPQKKAPEQNAQEDQAREIEERWCGGIGSAEDMQAKALKKQEAAAKRERAMAYALTHQRQAGSRKQKAADVQGPEADENQWGRNWVERWVAVRPWENRLLDSNAKENVPIGDDKEAEENGDRDVNKPKGKVAVSGIQSNGSSGTKDAKHKKSHSDASGSSSGQSAAAPPAASLGSSKLKPKPSGQTSEEVSPQPTDPATRSTSNPKERPAAQVNAPTKKRLSLPSNGTAGGGARKGQANSSEKARPVGSKNKAKGASKSEPKQRRSPGSATAKRAQAQA

SEQ ID NO: 5840 - protein, 430 aa, Triticum aestivum
MGISSKWIKSLVGIKKHGKAQNGESSRERSSAAQLLHKRKHSVDTEGSLAVAEHTVQIEPLASDTNTQTISSETELNTKEHQAATVIQSAFRAFLARRALRALKGLVRLQALVRGHAVRKQAAETLQCMQSLVKAQARVRARQVRIGLEGQVPQKKAPEQNAQEDQAREIEERWCGGIGSAEEMQAKALKKQEAAAKRERAMAYALTHQRQAGSRKQKAADVQGPEADENQWGRNWVERWVAVRPWENRLLDSNAKENVPIGDDKEAEENGDRDVNKPKGKVAVSGIQSNGSSGTKDAKHKKSHSDASGSSSGQSAAAPPAASLGSSKLKPKPSGQTSEEVSPQPTDPATRSTSNPKERPAAQVNAPTKKRLSLPSNGTAGGGARKGQANSSEKARPVGSKNKAKGASKSEPKQRRSPGSATAKRAQAQA

SEQ ID NO: 5841 - protein, 75 aa, Secale cereale
MGISSKWIKSLVGIKKHGKAQNGESSRERSSAAQVLHKRKHSVDTEGALAVAEHTVQTEPLASDTNTQTISSQTD

SEQ ID NO: 5842 - protein, 443 aa, Triticum aestivum
MGISSKWIKSLVGIKKHGKAQNGESSRERSSAAQVLHKRKHSVDTEGALAVAEHTVQIEPLASDTNTQTISSETELNTKEHQAATVIQSAFRAFLARRALRALKGLVRLQALVRGHAVRKQAAETLQCMQSLVKAQARVRARQVRIGLEGQVPQKKAPEQNAQEDQAREIEERWCGGIGSAEDMQAKVLKKQEAAAKRERAMAYALTHQRQAGSRKQKAADVQGPEADENQWGRNWVERWVAVRPWENRLLDSNAKENVPFGDDKEADENGDRDVNKPKGKVAVSGILSNGSSQTKDAKHKKSHSDASGSSSGQSAAVPPTASLGSSKLKPKPSDQTSEEVSPQPKPSDQTSEEVSPQPTDPAPRSTSNPKERPAQVNAPTRKRLSLPNNATASGGARKGQASSSEKTRSVGSKNTAKGASKSEPKQRPSPGSATAKRVQAQA

SEQ ID NO: 5843 - protein, 445 aa, Secale cereale
MGISSKWIKSLVGIKKHGKAQNGESSRERSSAAQVLHKRKHSVDTEGALAVAEHIVQTEPLASDANTQTISSQTGLNAKEHQAATVIQSAFRAFLARRALRALKGLVRLQALVRGHAVRKQAAETLQCMQSLVKAQARVRARQVRIGLEGQVPQKKAPEKNPHEDQAREIEERWCGGIGSAEDMQAKVLKKQEAAAKRERAMAYALTHQRQAGSRKQKAADVQGPEADENQWGRNWVERWVAVRPWENRLLDGNAKENVPIGDDKEAEENGDRDVSKPKGKAAVSGIQSNGSSQTKDAKHKKSHSDASGSSSGQSAAVPPAASLGSSKLKPKPSDQTSEEVSPQPTDPAPRSTSNPKERPAAQVNAPTKKRLSLPNNATASGGAEKARRAAARKLGPLVPGTRRKERPSLNRSSGRALAAQPRSGFSHRPDPDESIHSLPFRSET

SEQ ID NO: 5844 - protein, 355 aa, Panicum virgatum
MRGKKPVKELKLAVPAQETPVDKFLTASGTFKDGELRLNQRGLRLISEENGDENQSTNLKVEDVQLSMDDLEMIQVIGKGSGGVVQLVRHKWVGTLYALKGIQMNIQESVRKQIVQELKINQATQSPHIVLCHQSFYHNGVIYLVLEYMDRGSLADIIKQVKTILEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGDGWLSFYELLEAIVDQPPPSAPADQFSPEFCSFISSCIQKDPAERMSASELLNHPFIQKFEGKDLDLRTLVESLEPPMNIPE

SEQ ID NO: 5845 - protein, 355 aa, Setaria italica
MRGKKPVMELKLAVPAQETPVDKFLTASGTFKDGELRLNQRGLRLISEENGDENQSTNLKVEDVQLSMDDLEMIQVIGKGSGGVVQLVRHKWVGTLYALKGIQMNIQESVRKQIVQELKINQATQSPHIVMCHQSFYHNGVIYLVLEYMDRGSLADIIKQVKTVLEPYLAVLCKQVLEGLLYLHHERHVIHRDIKPSNLLVNRKGEVKITDFGVSAVLASSMGQRDTFVGTYNYMAPERISGSSYDYKSDIWSLGLVILECAIGRFPYIPSEGEGWISFYELLEAIVDQPPPSAPADQFSPEFCSFISSCIQKDPAERMSASELLNHPFIKKFEGKDLDLRTLVESLEPPMNIPE

SEQ ID NO: 5846 - protein, 355 aa, Zea mays
MKGKKPVKELKLTVPAQETPVDKFLTASGTFKDGELRLNQSGLRLISEENGDEDESTKLKVEDVQLSMDDLEMIQVIGKGSGGVVQLVRHKWVGTLFALKGIQMNIQESVRKQIVQELKINQATQSPHIVMCHQSFYHNGVIYLVLEYMDRGSLADIVKQVKTILEPYLAVLCKQVLEGLLYLHHQRHVIHRDIKPSNLLVNRKGEVKITDFGVSAVLASSIGQRDTFVGTYNYMAPERISGSTYDYKSDIWSLGLVILECAIGRFPYIPSEGEGWLSFYELLEAIVDQPPPSAPADQFSPEFCSFISSCIQKDPAQRMSASELLNHPFLKKFEDKDLNLGILVENLEPPMNIPE

SEQ ID NO: 5847 - protein, 213 aa, Secale cereale
ASLGPRRARLGPLLPPQLGHCSFPLLPPLPAATASAAEPCAPEPEPPRRRRRGRWEAKREEPRVVTLRPVEATPESFAPFGQVIAASPDGDQFGPHDAQLDLSRGIPRFYIMRLESRPLKFSSITHHASVTQCLGSIGGQDWYLGVAKPSIVDEQSGQDGGRSPVQSRAGHYYLPPDPAEVCRFPGLRSQVSQAARWDLARRAAVQGRRRGFL

SEQ ID NO: 5848 - protein, 188 aa, Secale cereale
MEAKREEPRVVTLRPVEATPESFAPFGQVIAASPDGNQFGPHDAQLDLSRGIPRFYIMRLESRPLKFSSITHHASVTQCLGSIGGQDWYLGVAKPSIVDEQSGQDGGRSPVQSRAGHYYLPPDPAEVCVFRVSGAKFLKLHAGTWHAGPLFKADAVDFYNLELSNTNVVDHTTHYFKKQDGVTFVIED

SEQ ID NO: 5849 - protein, 242 aa, Avena sativa
MQQALGLGHACSLGRYCRRSTATTPPPSPPPHRTNSKSGRAVRAEAASSAPQTMEAKLEEPRVVKLRAVEATPESFAPFGQVIAASPDGDQFGPHDAQLDLSRGIPRFYIMRLESKPLKFSSITHHASVTQCLGSIGGQDWYLGVAKSSIVDGAPPEQSGGRSPVQSRAGHFYLPPDPAEVCVFRVSGPKFLKLHAGTWHAGPLFKADAVDFYNLELSNTNVVDHTTHYFKKQDGVTFVIED

SEQ ID NO: 5850 - protein, 189 aa, Brachypodium distachyon
MEPAKREEPRAVALRAVEATPESFAPFGQVIAASPDGDHFGPHDAQLDLSRGIPRFYIMRLESRPLKFSNITHHASVTQCLGSIGGQDWYLGVAKPSIVDGAPGQSAGRDPVQSRAGHYYLPPDPAEVCVFRVSGPKFLKLHAGTWHAGPLFKADAVDFYNLELSNTNVVDHTTHNFAKQDGVTFVIED

SEQ ID NO: 5851 - protein, 126 aa, Triticum aestivum
MKAKAGSRAGDSRLAVKKSKAEKDPNKPKRPPSAFFVFMDTFRKEYKEKHPDVKQVSVIGKAGGEKWKSLSDAEKAPYAAKAEKLKAEYAKKIDAYNNPQAGEASGDSDKSKSEVNDEDDGSEGDE

SEQ ID NO: 5852 - protein, 126 aa, Pseudoroegneria spicata
MKAKAGSRAGDSRLAVKKSKAEKDPNKPKRPPSAFFVFMDSFRKEYKEKHPDVKQVSVIGKAGGEKWKSLSDAEKAPYAAKAEKLKAEYTKKIDAYNNPQAGEASGDSDKSKSEVNDEDDGSEGDE

SEQ ID NO: 5853 - protein, 124 aa, Triticum aestivum
MKAKAGSRAGDSRLAVKKSKAEKDPNKPKRPPSAFFVFMDTFRKEYKEKHPDVKQVSVVGKAGGEKWKSLSDAEKAPYAAKAEKLKAEYTKKIDAYNNPQAGEASGDSDKSKSEVNDEDSEGDE

SEQ ID NO: 5854 - protein, 124 aa, Secale cereale
MKAKVGSRAGDSRLAVKKSKAEKDPNKPKRPPSAFFVFMDTFRKEYKEKHPDVKQVSVIGKAGGEKWKSLSDAEKAPYTAKAEKLKAEYTKKIDAYNNPQAGEASGDSDKSKSEVNDDDSEGDE

SEQ ID NO: 5855 - protein, 115 aa, Secale cereale
RGSRLAVKKSKAEKDPNKPKRPPSAFFVFMDTFRKEYKEKHPDVKQVSVIGKAGGEKWKSLSDAEKAPYTAKAEKLKAEYTKKIDAYNNPQAGEASGDSDKSKSEVNDDDSEGDE

SEQ ID NO: 5856 - protein, 150 aa, Avena sativa
QQESAAHLPHHRSASTPALRSPRLRDEGEGERPRRRLEARGEEGQGREGPQQAQAPPERFFVFMEGFRKDYKEKHPDNKQVSVVGKAGGEKWKSLTDAEKAPYVAKAEKLKAEYTKKIEAYNNPQAEASGDSEKSKSEVNDEDEGSEADE

SEQ ID NO: 5857 - protein, 150 aa, Avena sativa
QQESAAHLPHHRSASTPALRSPRLRDEGEGERPRRRLEARGEEGQGREGPQQAQAPPERFFVFMEGFRKDYKEKHPDNKQVSVVGKAGGEKWKSLTDAEKAPYVAKAEKLKAEYAKKIEAYNNPQAEASGDSEKSKSEVNDEDEGSEADE

SEQ ID NO: 5858 - protein, 375 aa, Triticum aestivum
MALPAAKAAPATPFSSQPHGGGVLLRRPPSPPPPAAALRLGPLFWPWQKVKVGPLSVSPMGFGTWAWGNQLLWGYQESMDSELQECFNLALKNGINLFDTADSYGTGKLNGQSERLLGKFIRECQGPIKSPDDVIIATKFAAYPWRLTSGQFVNACKSSLERLQIDRLGIGQLHWSTANYAPLQERALWDGLVEMYDKGLVRAVGVSNYGPKQLLKIHSYLASRGVPLSSAQVQFSLLSMGDEQMELKTVCDSLGVRLIAYSPLGLGMLTGKYDASNLPNGPRSVLFRQILPGLESLLSCLKSIADRKGKTMSQVAINWCICNGAIPIPGVKTVRHVEDNLGALGWRLSPDEISELEAAAMECPKKMVQNIFQTA

SEQ ID NO: 5859 - protein, 460 aa, Triticum aestivum
MAHVLAAAEPLTLLKRPPPQNDGFGDDNGSTEEKAPKARRRESDPAAALAAARHEFGEHGGVNMSIEASATFTVMEPDTMRRLFTGELGPERGDLYIYSRHFNPTVLALGRQMAALEGTEAAYCTASGMSAISCVLMQLVGAGGHVVASRCLYGGTHALLSRFLPRTSGVQATFVDADDEAAVRAAIRPGETRVVYVETMSNPTLAVADIPMLARVAHEAGAKLVVDNTFTPVVVSPARLGADVVVHSVSKFISGGADIIAGAICGPASLVNSMMDLQDGALMLLGPTMNAKVASELAARLPHLPLRMQEHSRRAAEFAARMRRQGLRVTYPGLPDHPHHARLRAMGNPGYGAGGMLCLDMGTEERANRLMYHLQNTTQFGFMAVSLGFYDTLMSCSGNSTSSEMDPEDRARAGISPGLIRMSVGYNGTLEQRWAQFERALALMQQQDTPAAAAKYGKPV

SEQ ID NO: 5860 - protein, 373 aa, Avena sativa
MSLPAAKAAPAMPFASQPHGGGILLRRPSSPPVPAAALRLGPLFWPWEKVKVGPLSVSPMGFGTWAWGNQLLWGYQESMDSELQDCFNLALKNGINLFDTADSYGTGKLNGQSERLLGKFISEGPIKSPDDVVIATKFAAYPWRLTSGQFVNACKSSLDRLQIDRLGIGQLHWSTANYAPLQERALWDGLVDMYDKGLVRAVGVSNYGPKQLLKIHGYLASRGVPLSTAQVQFSLLSMGDEQMELKTVCESLGVRVIAYSPLGLGMLTGKYDASNLPNGPRSVLFRQILPGLESLLSCLKSIADRKGKTMSQVAINWCICKGAIPIPGVKTVRHVEDNLGALGWRLSPDEISELEAAAMECPKKMVQNIFQTA

SEQ ID NO: 5861 - protein, 378 aa, Setaria italica
MALPPAAGAAAAPVTPFAAQPRGHGGGGLRRTSPAPPAAALRLGPLFWPWEKVKVGPLSVSPMGFGTWAWGNQLLWGYQESMDSELQECFNLALKNGINLFDTADSYGTGKLNGQSERLLGRFIREFEGPIKSPDDVVIATKFAAYPWRLTSGQFVGACKSSLERLQLDRLGIGQLHWSTANYAPLQERALWDGLVEMYEKGLVRAVGVSNYGPKQLLKIHSYLASKGVPLSSAQVQFSLLSMGDEQMELKTVCDSLGIRLIAYSPLGLGMLTGKYDASNLPKGPRSVLFRQILPGLESLLSCLRRIAEKKGKTMSQVAINWCICRGTIPIPGVKTVRHVEENLGALGWRLSPAEISELESAAMAAPKRMIQNVFQTA

SEQ ID NO: 5862 - protein, 375 aa, Oryza sativa
MALPVTTRAAPAMPFAPQPRTAGGGLLRRPSPPAAALRIAPPLFWPWQKVKVGPLSVSPMGFGTWAWGNQLLWGYQESMDTELQECFNLALKNGINLFDTADSYGTGRLNGQSERLLGKFIREYEGPMKSPDDVIIATKFAAYPWRLTSGQFVSACKSSLERLQLDRLGIGQLHWSTANYAPLQERALWDGLVEMYEKGLVRAVGVSNYGPKQLLKIHSHLSSRGVPLSSAQVQFSLLSMGDEQMELKTVCDSLGIRLIAYSPLGLGMLTGKYTTSNLPSGPRSVLFRQILPGLESLLTCLKRIAERKGKTMSQVAINWCICKGTIPIPGVKTVRHVEDNLGALGWRLSPAEVSELEAAAMESPKRMVQNIFQTA

SEQ ID NO: 5863 - protein, 316 aa, Oryza sativa
MGFGTWAWGNQLLWGYQESMDTELQECFNLALKNGINLFDTADSYGTGRLNGQSERLLGKFIREYEGPMKSPDDVIIATKFAAYPWRLTSGQFVSACKSSLERLQLDRLGIGQLHWSTANYAPLQERALWDGLVEMYEKGLVRAVGVSNYGPKQLLKIHSHLSSRGVPLSSAQVQFSLLSMGDEQMELKTVCDSLGIRLIAYSPLGLGMLTGKYTTSNLPSGPRSVLFRQILPGLESLLTCLKRIAERKGKTMSQVAINWCICKGTIPIPGVKTVRHVEDNLGALGWRLSPAEVSELEAAAMESPKRMVQNIFQTA

SEQ ID NO: 5864 - protein, 99 aa, Secale cereale
PRTLFWPWQKVKVGPFPVSPMGFGTWAWGNQLLWGYQESMDSELQECFNLALKNGINLFDTADSYGTGKLNGQSERLLGKFIRECQGPIKNSRRCDHRN

SEQ ID NO: 5865 - protein, 371 aa, Sorghum bicolor
MALLPAAGAAAPATPSAAKPCGLRRPSAPPAAALRLGPLFWPWEKVKIGPLSVSPMGFGTWAWGNQLLWGYEESMDNELQDCFNLALRNGINLFDTADSYGTGRLNGQSERLLGKFILECEGTIKSPDDVIIATKFAAYPWRLTSGQFVSACKSSLERLQLDRLGIGQLHWSTANYAPLQERALWDGLVEMYDKGLVSAVGVSNYGPKQLLKIHSYLASKGVPLSSAQVQFSLLSMGDDQMELKTVCDSLGIRLIAYSPLGLGMLTGKYDASNLPKGPRSVLFRQILPGLESLLSCLRRIAEKKGKTMSQVAINWCICKGTIPIPGVKMVRHVEENLGALGWRLSSAEIAELEAAAMAAPKKMVQNVFQTA

SEQ ID NO: 5866 - protein, 371 aa, Zea mays
MALPPGAGAVAPATPFAANPCRLRRASGPPAAALRLGPLFWPWEKVKIGPLSVSPMGFGTWAWGNQLLWGYQESMDNELQDCFNLALRNGINLFDTADSYGTGRLNGQSERLLGKFILEFEGRIKSPDDVVIATKFAAYPWRLTSGQFVSACKSSLERLQLDRLGIGQLHWSTANYAPLQERALWDGLVEMYEKGLVSAVGVSNYGPKQLLKIHSYLASRGVPLSSAQVQFSLLSMGDDQMELKSVCDSLGIRIIAYSPLGLGMLTGKYGASNLPKGPRSVLFRQILPGLEPLLSCLRRIAEKKGKTMPQVAINWCMCKGTVPIPGVKTVRHVQENLGALGWRLSSAEISELESAAMAAPRKMIQNVFQTA

SEQ ID NO: 5867 - protein, 316 aa, Secale cereale
MGFGTWAWGNQLLWGYQESMDSELQECFNLALKNGINLFDTADSYGTGKLNGQSERLLGKFIRECQGPIKSPDDVIIATKFAAYPWRLTSGQFVNACKSSLERLQIDRLGIGQLHWSTANYAPLQERALWDGLVEMYDKGLVRAVGVSNYGPKQLLKIHSYLASRGVPLSSAQVQFSLLSMGDEQMELKTVCDSLGVRLIAYSPLGLGMLTGKYDASNLPNGPRSVLFRQILPGLESLLSCLKSIADRKGKTMSQVAINWCICKGAIPIPGVKTVRHVEDNLGALGWRLSPGEISDLEAAAMECPKKMVQNIFQTT

SEQ ID NO: 5868 - protein, 412 aa, Brachypodium distachyon
MALPTAKAAPFASQPHGRGNLLRRPPSSAPAPAAALRLGPLFWPWEKQFRTPDYTGAIPCTKHSPLLRNVTEVLNSVEPTSQFCISVKVGPLSVSPMGFGTWAWGNQLLWGYQESMDSELQECFNLALKNGINLFDTADSYGTGKLNGQSERLLGKFIREFEGPIKSPDDVVIATKFAAYPWRLTSGQFVNACKSSLERLQIDRLGIGQLHWSTANYAPLQERVLWDGLVEMYAKGLVRAVGVSNYGPKQLLKIHGYLASRGVPLSSAQVQFSLLSMGDEQMELKSVCDSLGVRLIAYSPLGLGMLTGKYDASNLPNGPRSVLFRQILPGLESLLSCLGSIAERKGKTMSQVAINWCICKGAVPIPGVKTVKHVEDNLGALGWRLSPSEISELEAAAMDSPKKMLQNIFQTA

SEQ ID NO: 5869 - protein, 316 aa, Pseudoroegneria spicata
MGFGTWAWGNQLLWGYQESMDSELQECFNLALKNGINLFDTADSYGTGKLNGQSERLLGKFIRECQGPIKSPDDVIIATKFAAYPWRLTSGQFVNACKSSLERLQIDRLGIGQLHWSTANYAPLQERALWDGLVEMYDKGLVRAVGVSNYGPKQLLKIHSYLASRGVPLSSAQVQFSLLSMGDEQMELKTVCDSLGVRLIAYSPLGLGMLTGKYDASNLPNGPRSVLFRQILPGLESLLSCLKSIADRKGKTMSQVAINWCICKGAIPIPGVKTVRHVEDNLGALGWRLSPDEISELEASAMECPKKMVQNIFQTA

SEQ ID NO: 5870 - protein, 316 aa, Triticum aestivum
MGFGTWAWGNQLLWGYQESMDSELQECFNLALKNGINLFDTADSYGTGKLNGQSERLLGKFIRECQGPIKSPDDVIIATKFAAYPWRLTSGQFVNACKSSLERLQIDRLGIGQLHWSTANYAPLQERALWDGLVEMYDKGLVRAVGVSNYGPKQLVKIHSYLASRGVPLSSAQVQFSLLSMGDEQMELKTVCDSLGVRLIAYSPLGLGMLTGKYDASNLPNGPRSVLFRQILPGLESLLSCLSGIADRKGKTMSQVAINWCICKGAIPIPGVKTVRHVEDNLGALGWRLSPDEISELEAAAMECPKKMVQNIFQTA

SEQ ID NO: 5871 - protein, 314 aa, Avena sativa
MGFGTWAWGNQLLWGYQESMDSELQDCFNLALKNGINLFDTADSYGTGKLNGQSERLLGKFISEGPIKSPDDVVIATKFAAYPWRLTSGQFVNACKSSLDRLQIDRLGIGQLHWSTANYAPLQERALWDGLVDMYDKGLVRAVGVSNYGPKQLLKIHGYLASRGVPLSTAQVQFSLLSMGDEQMELKTVCESLGVRVIAYSPLGLGMLTGKYDASNLPNGPRSVLFRQILPGLESLLSCLKSIADRKGKTMSQVAINWCICKGAIPIPGVKTVRHVEDNLGALGWRLSPDEISELEAAAMECPKKMVQNIFQTA

SEQ ID NO: 5872 - protein, 1067 aa, Triticum aestivum
MRLTVRVIGARNLRAMDFNGFSDPYVKLQVGKQRFKTKVVKMNLNPEWDQEFSFVVADVREVLKLDVYDEDMIGTDDFLGQVRVTLEDLLAVENFSLGTRWYQLLPKTKSDKAINCGEICLAISLETAGATRSWSDDLATELTGTQKEDSLQSSQSAGSSSAALAYEENEASKEDNVNEYFSDGTEIPEDDKCGEVRDPEDRFNGIPTEISNEAETSKTEKLDKPSLVDRVYQMFAKKNDDISSTSLTKTEALEEVQQAPAVFEAPLSQNSDISSEITFAELLRSFESRHEEVEMPVNLQGILVNQSYFTSPSDLNNLLFSPDSDFRQTLVQLQGCTDFKTEPWRIDNDGESLKRVISYTTAPSKLVKAVKATEEQSYLKADGKEYSVLLSASTPDVPCGTYFRTEVLFRIMPGPELDSEQQTSHLVISWRMNFLQSTMMKSIIENGARQGLEQNYSQFSDLLSEKIKPIDVDDAGSDKEQVLASLQGGQESDWKIAFLYFCNFGVLSSLFVALYIGVHVSLVNSGAVQGLEFPGLDLPDSVSEIVMGGLLFLQVQHIFKKIMCFFQAREQKVGDHGVKAQGDGWLLTVALIEGTNLAPVDATGFSDPYVVFTCNGKTKTSSIKFQTLEPQWNDIFEFDAMDDPPSVMNVHVYDFDGPFDEVTSLGHAEINFVKSNLSELADVWIPLQGNLAKSRQSKLHLRIFLNNSKGTGMVTEYLSKMEKEVGKKMTLRSPRTNTAFQELFSLPAEEFLISSFTCYLKRKLPTQGHLFLSPRIIGFYSSMFGRKTKFFFLWEDIEDIQAIPPSLSTWSPSLAITLHRGRGMDAKHGAKSVESGKLKFSLQSFASFSVANRTIMALWKARSLSSESKVQIAEEQSQNNTLQSEDSGIFVGVDDSKSLQMSEVFSSTISANMNSLLEVFEGGSLEMKVMEKVGCLKYSATQWESDKPEEYQRQIHYKFSRKLSPVGGEVTGTQLKSPMPNKKGWIIEEVMELQGVLLGDFFTLHIKYQIEDLAPKQKACSVQVYLGIEWSKTTRHQKRIEKNVLSSSSARLKEMFSLASKQLSHTR

SEQ ID NO: 5873 - protein, 1067 aa, Secale cereale
MRLTVRVIGARNLRAMDFNGFSDPYVKLQVGKQRFKTKVVKMNLNPEWDQEFSFVVADVREVLKIDVYDEDMIGTDDFLGQVRVTLEDLLAAENFSLGTRWYQLLPKAKSDKAVDCGEICVAISLETAGATRSWSDDIATELTGTQEEYSLRSSQSAGASSAALAYEENEASKEDNVNDYFSDGTEIPEEDKCGEVRDPEDRFNGIPTEISNEAETSKTEKLDKPSLVDRVYQMFAKKNDDISSTSLRKTEASEEVQQAPTVFEAPLSENSEICSEVTFAELLRSFESRHEEVEMPVNLQGILVNQSYFTSPSDLNNLLFSPDSDFRQTLVQLQGCTDFKTEPWRIDNDGESLKRVISYTTAPSKLVKAVKATEEQSYLKANDKEYSVLLSASTPDVPCGTYFRTEVLFRIMPGPELDSEQQTSHLVISWRMNFLQSTMMKSIIENGARQGLEQNYSQFSDLLSEKIKPIDVDDAGSDKEQVLASLQGGQESDWKIAFLYFCNFGVLSSLFVALYIGVHVSLVNSGAVQGLEFPGLDLPDSLSEIVMGGLLFLQVQHIFKKIMCFFQAREQKVGDHGVKAQGDGWLLTVALIEGTNLAPVDATGFSDPYVVFTCNGKTKTSSIKFQTLEPQWNDIFEFDAMDDPPSVMNVHVYDFDGPFDEVTSLGHAEINFVKSNLSELADVWIPLQGNLAKSRQSKLHLRIFLNNSKGTGMVTEYLSKMEKEVGKKMTLRSPRTNTAFQELFSLPAEEFLISSFTCYLKRKLPTQGHLFLSPRIIGFYSSMFGRKTKFFFLWEDIEDIQAIPPSLATWSPSLSITLHRGRGMDAKHGAKSVESGKLKFSLQSFASFSVANRTIMALWKARSLSSESKVQIAEEQSQNNTLQSEDSGIFVGVDDSKSLQMSEVFSSTISANMNSLLEVFEGGSLEMKVMEKVGCLKYSATQWESDKPDEYQRQIHYKFSRKLSPVGGEVTGTQLKSPMPNKKGWIIEEVMELQGVLLGDFFTLHIKYQMEDLAPKQKACSVQVYLGIEWSKTTRHQKRIEKNVLSSSSARLKEMFSLASKQLSNTR

SEQ ID NO: 5874 - protein, 575 aa, Triticum aestivum
MRLTVRVIGARNLRAMDFNGFSDPYVKLQVGKQRFKTKVVKMNLNPEWDQEFSFVVADVREVLKLDVYDEDMIGTDDFLGQVRVTLEDLLAAENFSLGTRWYQLLPKAKSDKAVDCGEICLAISLETAGATRSWSDDLATELTGTQKEYSLQSSQSAGASSAALAYEENEATKEDDVNEYFSDGTEIPEDDKCGEVRDPEDRLIPTEISSEAGTSKTEKLDKPSLVDRVYQMFAKKNDDISSTSLTKTEALEEVQQAPAVFEAPLIQTSDICLEITFAELLGSFESRHGQVEMPVNLQGILVNQSYFTSPSDLNNLLFSPDSDFRQTLVQLQGCTDFKTEPWRIDNDGESLKRVISYTTAPSKLVKAVKATEEQSYLKADGKEYSVLLSASTPDVPCGTYFRTEVLFRIMPGPELDSEQQTSHLVISWRMNFLQSTMMKSIIENGARQGLEQNYSQFSDLLSEKINPIDVDDAGSDKEQVLASLQGGQESDWKIAFLYFCNFGVLSSLFVALYIGVHVSLVNSGAVQGLEFPGLDLPDSISEIVMGGLLFLQVQHIFKKIMCFFRQENKKLVIMV

SEQ ID NO: 5875 - protein, 1065 aa, Brachypodium distachyon
MRLNVRVIGARNLRAMDFNGFSDPYVKLQVGKQRFKTKVVKMNLNPEWDQEFSFVVSDVREVLKFCVYDEDMIGIDDFLGQVKVPLEDLLAAENFSLGTQWYQLLPKSKSDKAVDCGEICLAISLETAGATRSWSDDLATELTGIHSDYSLSSSQSTGTSLALAYQENEASKEDNINEYSDGSEIHEEDKCSIGREQTTAEAKPNGISSGAETSKAEKLDKTSLVDRVCQMFVRKNDDAVPTTSLAKTEASEEVQEAPAGFEASVSQSDDMCSEAPFDELLRSFESRHEGVEMPVNLQGILINQSYFTSPNDLNNLLFSPDSDFRRTLVQLQGCTDFTSEPWIIGNGGETLKRVITYTTAPSKLVKAVRATEEQSYLKADGKEYSVLLSASTPDVPCGTYFRTEVLFRIMPGPELDSEQQTSHLVISWRMNFLQSTMMKGIIENGARQGLEQNYAQFLDLLSEKVKPIDVEDAGSDKEQVLSSLQGGQESDWKIAFLYFCNFGVLSSLFVALYIVVHVSLVNSGAVQGLEFPGLDLPDSLSEIVMGGLLFLQVQNMYKKLMCFFQAREQKVGDHGVKAQGDGWLLTVALIEGTKLAPVDATGFSDPYVVFTCNGKTKTSSIKFQTLEPQWNDIFEFDAMDDPPSVMNVHVYDFDGPFDEVTSLGHAEINFVKSNLSELADVWIPLQGNLAQSRQSKLHLRIFLNNSKGTGMVTEYLSKMEKEVGKKMTLRSPRTNTAFQELFSLPAEEFLISSFTCYLKRKLHTQGHLFLSPRIIGFYSSMFGRKTKFFFLWEDIEDIQAIPPSLSSWSPSLAIILHKGRGMDAKHGAKSVENGKLKFSLQSFASFSVANRTIMALWKARSLSSETKVQIAEEQSHNNTLQSEDSGIFAGVEDSKSLQMSEVFSSVISANMASLMEVFGGGSLEMKVMEKVGCLKYSATQWEPDKPDEYQRQIHYKFSRKLSPVGGEVTGTQLKSPMPNNKGWIIEEVMELQGVLLGDFFTLHIKYQVEDLAPKQKACSVQVYLGIEWSKTTRHQKRIEKNVLSSSSARLKEMFSLASKQLSHAR

SEQ ID NO: 5876 - protein, 469 aa, Triticum aestivum
KSDKAVDCGEISLAISLETAGATRSWSDDLATELTGTQKEYSLQSSQSAGASSAALAYEENEASKEDNVNEYFSDGTEIPEEDKCGEVRDSEDRFNGITTEISNEAETSKTEKLDKPSLVDRVYQMFAKKNDDISSTSLTKTEALEEVQQAPAVCEAPLSQNSDICSEITFAELLRSFESRHEEVEMPVNLQGILVNQSYFTSPSDLNNLLFSPDSDFRQTLVQLQGCTDFKTEPWRIDNDGESLKRVISYTTAPSKLVKAVKATEDQSYLKADGKEYSVLLSASTPDVPCGTYFRTEVLFRIMPGPELDSEQQTSHLVISWRMNFLQSTMMKSIIENGARQGLEQNYSQFSDLLSEKIKPIDVDDAGSDKEQVLASLQGGQESDWKIAFLYFCNFGVLSSLFVALYIGVHVSLVNSGAVQGLEFPGLDLPDSISEIVMGGLLFLQAQHIFKKIMCFFRQENKKLVIMV

SEQ ID NO: 5877 - protein, 1068 aa, Setaria italica
MRLTVRVIEARNLRAMDSNGFSDPYVKLQLGKQRFKTKVIKMNLNPTWDQEFSFLVGDVRDVLKLDVYDEDILQMDDFLGQLRVPLEDVLAAEDLSLGTQWYQLLPKGKTNKAVDCGEICVSIYLESAGATRSWSDDLSAELTDIERDYSLSSQSTAPSIALAYRETETCKEDSINEYSDGSEIPAEDKCSEVTDRNQAAAQDRSKENSNAALNGAETSSSKTDKPSFVDRVCQIFGKKNGDVVPTSSEISEASEQVQEEPRGYEIPVSQDDKTCPEAPFSELLKSLESRHEGVEMPVNLPGILVNQSYLASPSDLNNLLFSPDSDFKQTMIELQGCTDFKTEPWRLDNDGESLKRVVTYTTAPSKLVKAVRATEEQSYLKADGKEYAVLLSVSTPDVPCGTYFRTEILFRIMPGPELDSQQQTSHLVISWRMNFLQSTMIKSMIENGARQGLEQNYSQFSDLLSQKIKPIDVEGSGSDKEQVLASLQGGQESDWKIAFLYFCNFGVLSSLFVSIYIVLHVLRVNSSSVQGLEFPGLDLPDSLSEIIMGGLLFLQVQNILKKITCFVQARGQKGGDHGVKAQGDGWLLTVALIEGIKLAPVDATGFSDPYVVFTCNGKTKTSSIKFQTLEPQWNEIFEFDAMDDPPSVMSVHVYDFDGPFDEVTSLGHAEINFVKSNLSALADVWVPLKGNLAQSWQSKLHLRVFLNNSKGTGMVTEYLSKMEKEVGKKMTLRSPRTNTAFQELFSLPAEEFLISSFTCYLRRKLPTQGHLFLSPRTIGFYSSMFGRKTKFYFLWEDIEDIQGIPQSISSWSPSVVITLHRGRGMDAKHGAKSVDNGKLKFCLQSFASFSVAHRTIMALWKARSLSTELKVQLAEEQSQNNTLQSEDSGIFVGIEDAKGLQMTEVFSSTISTNMASLMEVFEGGPLEMKVMEKVGCQKYSATQWESDKPNEYQRQIHYKFSKKLSPVGGEVTGTQQKSPMPNKKGWIIEEVMELQGVLLGDFFTLHIKYQIEDLAPKQRASSVQVSLGIEWSKSTRHQKRIEKNVLSSSSARLKEMFNLASRELSHAR

SEQ ID NO: 5878 - protein, 1071 aa, Oryza sativa
MRLNVRVIEARNLRAMDSNGFSDPYVKLQLGKQRFKTKVVKKNLNPAWDQEFSFSVGDVRDVLKLYVYDEDMIGIDDFLGQVKVPLEDVLAADNYSLGARWFQLLPKGKTEKAIDCGEICVAMSLETAGATRSWSDDLVSELTDIQKDYSLSSQGTGTSVALSYQESEACQEESVNGNLGRAGFTEEDNCSQDTDRNQTTAEDKSNGIPAAASTGIEVSKTDKSNKPSFVDRVCQMFVRKSDDVVTTPLVTTDKSEDVQEATTGYEAPATGSQTYSASTDTPFDELLKYFESKHQEVEMPVDLQGILVDKSYITSPSDLNNFLFSPDSNFRQTVVELQGCSDVKMESWKIDSDGESLKRVITYTTAPSKLVKAVKATEEQSYLKADGNGYSVLLSVSTPDVPCGTYFRTEILFRILPGPELDSEQLTSHLVISWRINFLQSTMMKGMIENGAKQGLQQNYAQFSDLLSQKIKPIDVDAGSDKGQVLASLQRGQESDWNIAFLYFCNFGVLCSLFVTIYIAVHVQLRSSGAHKGLEFPGLDLPDSLSEIVMGGLLFLQLRHIYKKISCFIQAREQKVGDHGVKAQGDGWLLTVALIEGTKLAPVDATGFSDPYVVFTCNGKSKTSSIKFQTLEPQWNDIFEFDAMDDPPSVMNVHVYDFDGPFDEVTSLGHAEINFVKSNLSELADVWIPLQGNLAQSWQSKLHLRIFLSNSKGSTMVTEYLSKMEKEVGKKMTLRSPRTNTAFQELFSLPAEEFLISSFTCCLKRKLHTQGHLFLSPRTIGFYSSMFGRKTKFFFLWEDIEEIQAVPQSISSWSPSLVITLHKGRGMDAKHGAKSVDNGRLKFCLQSFASFSVANRTIMALWKARSLSSEYKMQIAEEQSQNNDTLQSEDSGIFVGVEDAKNLQMNEVFSSSISANMASLMEVFGGGSFEMKIMNKVGCLNYSATQWESDKPDEYQRQIHYKFSRKLSPIGGEVTGTQQKSPMPNKAGWIIEEVMELQGILFGDFFTIHIRYQIEDLAPKQRACSVQVFLGIEWSKTTRHRKRIEKSVLSGSSARLKEMFILASKQLPHAR

SEQ ID NO: 5879 - protein, 554 aa, Triticum aestivum
MEATTTLTLSSSPAAAARRSPARATISDPHLRQYPVRTSRLRVAQSLASRPLSSGWRRRRRGSGLVVRAETFGQLTTGLESAWNKLRGVDVLTKETIVEPMRDIRRALLEADVSLPVVRRFVSSVSEKALGSDVIRGIRPEQQLVKIVHDELVQLMGGEVSDLVFAKTGPTVILLAGLQGVGKTTVCAKLAFYLKKLGKSCMLVAADVYRPAAIDQLTVLGEQVGVPVYSEGTAAKPAEITKNAVEEAKRNNIDAIVVDTAGRLQIDKTMMVELKEVKKAVNPTEILLVVDAMTGQEAAALVTTFNIEIGISGAILTKLDGDSRGGAALSVKEVSGKPIKFVGRGERMEDLELFYPDRMAQRVLGMGDVLSFVEKAQEVVRQEDTMELQKKIMSAKFDFNDFLKQTQNVAKMGSMSRVIGMIPGMNKVTPAQIREAEKRLAFVESMINAMTAEEREKPELLAESRERRIRVAEESEKTEQEVSQLVAQLFQMRAQMKKLMGMMQGQEAIAGMGDLMDSLNADEKAPPGTARRRRRRSEPPRQRELDAVGGASRP

SEQ ID NO: 5880 - protein, 552 aa, Triticum aestivum
ATTILTLSSSPAAAARRSPARATISDPHLRQYPVRTSRLRVAQSLASRPLSSGWRRRRRGSGLVVRAETFGQLTTGLESAWNKLRGVDVLTKETIVEPMRDIRRALLEADVSLPVVRRFVSSVSEKALGSDVIRGIRPEQQLVKIVHDELVQLMGGEVSDLVFAKSGPTVILLAGLQGVGKTTVCAKLAFYLKKLGKSCMLVAADVYRPAAIDQLTVLGEQVGVPVYSEGTAVKPAEITKNAVEEAKRNNIDAIVVDTAGRLQIDKTMMVELKEVKKAVNPTEILLVVDAMTGQEAAALVTTFNIEIGISGAILTKLDGDSRGGAALSVKEVSGKPIKFVGRGERMEDLELFYPDRMAQRVLGMGDVLSFVEKAQEVVRQEDTMELQKKIMSAKFDFNDFLKQTQNVAKMGSMSRVIGMIPGMNKVTPAQIREAEKRLAFVESMINAMTAEEREKPELLAESRERRIRVAEESEKTEQEVSQLVAQLFQMRAQMKKLMGMMQGQEAIAGMGDLMDSLNADEKAPPGTARRRRRRSEPPRQRELDAVGGASRP

SEQ ID NO: 5881 - protein, 552 aa, Avena sativa
MEGTATLTLSSSAAAAARRSPARSTVSALHLFRLPVRTPRLRAAHNLASRALSSGWRRRRRGSGLVVRAETFGQLTTGLESAWNKLRGVDVLSKESIVEPMRDIRRALLEADVSLPVVRRFVSSVSEKALGSDVIRGIRPEQQLVKIVHDELVQLMGGEVSDLVFAKTGPTVILLAGLQGVGKTTVCAKLAFYLKKLGKSCMLVAADVYRPAAIDQLTVLGEQVGVPVYSEGTAAKPAEITKNAVEEAKRNNIDAIVVDTAGRLQIDKAMMVELKEVKKAVNPTEILLVVDAMTGQEAAALVTTFNIEIGISGAILTKLDGDSRGGAALSVKEVSGKPIKFVGRGERMEDLELFYPDRMAQRVLGMGDVLSFVEKAQEVVRQEDTMELQKKILSAKFDFNDFLKQTQNVAKMGSMSRVIGMIPGMNKVTPAQIREAEKRLAFVESMINAMTDEEREKPELLAESRERRIRVAEESEKTEQEVGQLVAQLFQMRAQMQKLMGMMQGQEAIAGMGDLVDSLNADEKAPPGTARRRRRRSVPPRQRELEAVGGAQ

SEQ ID NO: 5882 - protein, 554 aa, Brachypodium distachyon
MESTAAAVLTLSSPSSSSAAAVAARRRSPSVSALHLSSPRLRAAVRSLALPASSLGWRRRRGSALVVRAETFGQLTTGLESAWNKLRGVDVLTKDSVAEPMRDIRRALLEADVSLPVVRRFVSSVSEKALGSGVIRGIRPDQQLVKIVHDELVQLMGGEVSDLVFAKTGPTVILLAGLQGVGKTTVCAKLAFYLKKLGKSCMLVAADVYRPAAIDQLTVLGEQVGVPVYSEGTGAKPAQITKNAVEEAKRKKIDAIVVDTAGRLQIDKTMMDELKEVKKAVNPTEILLVVDAMTGQEAAALVTTFNIEIGISGAILTKLDGDSRGGAALSVKEVSGKPIKFVGRGERMEDLELFYPDRMAQRVLGMGDVLSFVEKAQEVVRQEDTIELQKKIMSAKFDFNDFLKQTQNVAKMGSMSRVIGMIPGMNKVTPAQIREAEKRLAFVESMINAMTAEEREKPELLAESRERRIRVAEESEKTEQEVGQLVAQLFQMRAQMQKLMGMMQGQEAITGMGDLMDSLNADEKAPPGTARRRRRRNVPPRQREPEVVGGPSRP

SEQ ID NO: 5883 - protein, 550 aa, Setaria italica
MDATALALHSPPAAVVTRCSPEKLAFASLHLRCSSTGSFHLRASRNPALRALSLGWRRRRRRGNGLVVRAEMFGQLTTGLESAWNKLRGVDVLTKENITEPMRDIRRSLLEADVSLPVVRRFVSSISEKALGADTIKGVRPDQQLVKIVHDELVQLMGGEVSDLVFAKSGPTVILLAGLQGVGKTTVCAKLAFYLKKLGKSCMLVAADVYRPAAIDQLTILGEQVGVPVYSEGMGAKPPQITKNAVEEAKSKNIDAIVVDTAGRLQIDKAMMDELKEVKKAVNPTEVLLVVDAMTGQEAAALVTTFNIEIGITGAILTKLDGDSRGGAALSVKEVSGRPIKFVGRGERLEDLELFYPDRMAQRVLGMGDVLSFVEKAQEVMRQEEAVELQKKIMSAKFDFNDFLKQSQNVAKMGSMSRVIGMIPGMNKVTPAQIREAEKRLAFVESMINAMTAEEREKPELLAESRERRIRVAEESGKTEQEVSQLVAQLFQMRAQMQKLMGMVQGQEAIAGMGDLMDSLKAEEKAPPGTARRRRRNIKPKQRNLDAVLS

SEQ ID NO: 5884 - protein, 551 aa, Sorghum bicolor
MEATAPALSLSLALHSSPAVARRSAGKPIFAYLHRGGPSTASSVHLRASRTPASSPVWRRRRRGSGLVVRAEMFGQLTTGLESAWNKLRGVDVLTKENIAEPMRDIRRALLEADVSLPVVRRFVSSVSDKALGANAIRGVRPDQQLVKIVHDELVQLMGGEVSDLVFSKSGPTVILLAGLQGVGKTTVCAKLAFYLKKLGKSCMLVAADVYRPAAIDQLTILGKQVGVPVYSEGTEAKPTQITKNAMEEAKSKNIDAIVVDTAGRLQIDKSMMDELKEVKKAVNPTEVLLVVDAMTGQEAAALVTTFNIEIGITGAILTKLDGDSRGGAALSVKEVSGKPIKFVGRGERLEDLELFYPDRMAQRVLGMGDVLSFVEKTQEVMRQEEAVELQKKIMSAKFDFNDFLKQSQNVAKMGSMSRIIGMMPGMNKITPAQIREAEKRLAFVESMINAMTAEEREKPELLAESRERRIRVAEESGKTEQEVSQLVAQLFQMRAQMQKLMSMVQGQDAIAGMGDLMDSLKAEEKAPPGTARRRRRNSKPKQRELDAVLS

SEQ ID NO: 5885 - protein, 545 aa, Zea mays
MEATALASHSSPFAVHRSTGKPAFAYPHRGGPSMVSSVHLRTSRTPARSAAWRRRRRGTGLVVRAEMFGQLTTGLESAWNKLRGVGVLTKENIAEPMRDIRRALLEADVSLPVVRRFVSSVSDKALGANAIRGVRPDQQLVKIVHDELVQLMGGEVSDIVFAKSGPTVILLAGLQGVGKTTVCAKLAFYLKKLGKSCMLVAADIYRPAAIDQLTILGKQVGVPVYSEGTEAKPTQITKNAMEEAKSKNIDAIVVDTAGRLQIDRSMMDELKEVKKAVNPTEVLLVVDAMTGQEAAALVTTFNIEIGITGAILTKLDGDSRGGAALSVKEVSGRPIKFVGRGERLEDLELFYPDRMAQRVLGMGDVLSFVEKTQEVMRQEEAIELQKKIMSAKFDFNDFLKQSQNVAKMGSMSRIIGMMPGMNKITPAQIREAEKRLAFVESMINAMTAEEREKPELLAESRERRIRVAEESGKTEQEVSQLVAQLFQMRAQMQKLMGMVQGQEAIAGMGDLMDSLKSEEKAPPGTARRKRRNNTSKQRDLDAVLS

SEQ ID NO: 5886 - protein, 345 aa, Secale cereale
MPNVKSAGGAGAGAIPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASFAARQSPVIPPQIPPPAYVRPGHPRVSDFHDRFSEGDYGRDSDDIGNGVGEGGMKGKLKRTKKSPGDLDIYGGHRINVEAIGTLGEDNRSEIRSRGDKDVDNQHLQMEEKEVVSSVATVLSDLCGPGEWMPMKTLHTELMDQFGNVWHHSRVRKYLTADDWSPIEAKGRPWYGLLGLLRKYPEHFVINTKSKGRAISEFVSLVSLLS

SEQ ID NO: 5887 - protein, 343 aa, Triticum aestivum
MPNVKSAAGAGAIPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASFAARQAPVIPPQIPPPAYARPGHPRVSDFHDRFSEGDYGRDSDDIGNGVGEGGMKGKLKRTKKSPGDLDIYGGHRINVEAIGTLGEDNRSEIRSRGDKDVDNQHLQTEEKEVVSSVATVLSDLCGPGEWMPMKTLHTELMDQFGNVWHHSRVRKYLTADDWSVIEAKGRPWYGLLGLLRKYPEHFVINTKSKGRAISEFVSLVSLLS

SEQ ID NO: 5888 - protein, 345 aa, Pseudoroegneria spicata
MPNVKSAAGAGAGAIPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASFAARQSPVIPPQIPPPAYARPGHPRVSDFHDRFSEGDYGRDSDDIGNGVGEGGMKGKLKRTKKSPGDLDIYGGHRINVEAIGTLGEDNRSEIRSRGDKDVDNQHLQMEEKEVVSSVATVLSDLCGPGEWMPMKTLHTELMDQFGNVWHHTRVRKYLTADDWSPIEAKGRPWYGLLGLLRKYPEHFVINTKSKGRAISEFVSLVSLLS

SEQ ID NO: 5889 - protein, 342 aa, Triticum aestivum
MPNVKSAGGAGASAIPAGGDGEVEAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASFAARQAPVIPPQIPPPAYARPGHPRVSDFHDRFSEGDYGRDSDDIGNGVGEGGMKGKLKRTKKSPGDLDIYGGHRINVEAIGTLGEDNRSEIRSRGDKDVDNQHLQTEEKEVVSSVATVLSDLCGPGEWMPMKTLHTELMDQFGNVWHHSRVRKYLTADDWSVIEAKGRPWYGLLGLLRKYPEHFVINTKSKGRAISEFVSLVSLLS

SEQ ID NO: 5890 - protein, 337 aa, Avena sativa
MPPGSSAGDAEVEAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASFAAAAAAAQQAPVIPPQMPPPSYVRPGHPRASEFHDRFSEGDYGRDSGEIGNGISESGMKGKLKRTKKPPVDLEMYGGHRINVEPIGTLGEDNRSEIRMRVDRDMDNQQILQTEEKEVVSSVATVLSDLCGPGEWMPMRKLHTELLDQFGNVWHHTRVRKYLTAEDWSPIEAKGRPWFGLLGLLRKYPEHFVINTKCKGRAISEFVSLVSLLS

SEQ ID NO: 5891 - protein, 334 aa, Setaria italica
MPGGSSGADGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPQQLPPPSYARPGRPRLSDFHDRSFEGDYGREVDDIGNGISESGVRGKLIKRNKKSSGELDIYGGHRINVEAIGTLGEDSRSEIRSRGDRDMDNQQILQAEEKEVVSSVATVLSDLCGPGEWMPMTKLHTELLEQFGNVWHPSRVRKYLTTDDWSPTETKGRPWFGLLALLRKYPEHFVINTRSKGRVTSEFVSLVSLLS

SEQ ID NO: 5892 - protein, 336 aa, Saccharum officinarum
MPGGSSGADGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPPQLPPPSYAHARPGRPRLSEFHDRSFEGDYGREVDEIGNGINETVMRGKLIKRNKKSSVDLDIYGGHRINVEPIGTLGEDSRSEIRSRGDRDIDNQQALQAEEKDVVSSVATVLSDLCGPGEWMPMAKLHTELLDQFGNVWHPSRVRKYLTQDDWSPTETKGRPWFGLLALLRKYPEHFVINTRSKGRMTSEFVSLVSLLS

SEQ ID NO: 5893 - protein, 335 aa, Oryza sativa
MPAGSSGGDGEVEAGFAKLQGEDFEYYMQTYSIMLGRNSKKSTVDVDLSSLGGGMNISRHHARIFYDFQRRRFALDVIGKNGCLVEGVLHLPGNHPVKLDSQDLLQIGDKKFYFLLPTRSIFASAAAARHPPIIPQQMPPPSYVRTGRPRLSEFHDRSFEGDYGREGDEIGNGISESGGMRGKLIKRNKKLSAESEMYGGHRINVEAIGTLGEDSRSEIRSRGDRDMDNQHILQAEEKDVVSSVATVLSDLCGPGEWMPMAKLHTELLEQFGNVWHHSRVRKYLSPEDWSPTETKGRPWYGLLALLRKYPEHFVINTRSKGRVTSEFVSLVSLLS

SEQ ID NO: 5894 - protein, 334 aa, Panicum virgatum
MPGGSSAADGEVEAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPIIPPPLPPPSYARPGRPRLSDFHDRSFEGDYGREVDDIGTGISESGVRGKLIKRNKKSSGELDIYGGHRINVEAIGTLGEDSRSEIRSRGDRDIDNQQILQAEEKEVVSSVATVLSDLCGPGEWMPMAKLHTELLEQFGNVWHPSRVRKYLTTDDWSPTETKGRPWFGLLALLRKYPEHFVINTRSKGRVTSEFVSLVSLLS

SEQ ID NO: 5895 - protein, 333 aa, Pennisetum glaucum
MPGGSSGADGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFAAAAARHAAMIPPQLPPPSYARPGRPRLSDFHDRSYEGDYGREVDDIGNGISESGVRGKLIKRNKKSSGELDIYGGHRINVEAIGTLGEDSRSEIRSRGDRDMENQQILQAEEKEVVSSVATVLSDLCGPGEWMPMAKLHTELLEQFGNVWHPSRVRKYLTTDDWSPTETKGRPWFGLLALLRKYPEHFVINTRSKGRMTSEFVSLVSLLS

SEQ ID NO: 5896 - protein, 337 aa, Sorghum bicolor
MPGGSSGADGEVDAGFAKLQGEDFEYYMQTYSIMLGRNSKKSTVDVDLSSLGGGMNISRHHARIFYDFQRRRFALDVIGKNGCLVEGVLHLPGNPPVKLDSQDLLQIGDKKFYFLLPTRSIFASAAAARHAPVIPPQLPPPSYAHARGPGRPRLSEFHDRSYEADYGREVDEIGNGISETGMRGKLIKRIKKSSVDLDIYGGHRINVEPIGTLGEDSRSDIRSRGERDIDNQQALQAEEKDVVSSVATVLSDLCGPGEWMPMAKLHTELLDQFGNVWHPSRVRKYLTQDDWSPTETKGRPWFGLLALLRKYPEHFVINTRSKGRMTSEFVSLVSLLS

SEQ ID NO: 5897 - protein, 393 aa, Sorghum bicolor
MKVLAVLALVAAAAPFLRAAGQGEEGAGPLPFAVGAAPAGCDVAQGEWVRDDDARPLYQEWECPYIQPQLTCQAHGRPDKAYQSWRWQPRGCSLPSFNATLMLEMLRGKRMLFVGDSLNRGQYVSLLCLLHRAIPDGAKSFETVDSLSIFRAKDYDATIEFYWAPMLAESNSDDAVVHSADDRLIRGAPMDRHSSFWKGADVLVFNSYLWWVAGDKIQILRGADNDPSKDIVEMKSEEAYRLVLYQVVRWLERNVDAKKSRVFFVTASPTHTEGKAWGDKKEGANCYGQTSPISDGASSYRDSTSREMQRVTEEVLATSRVPVGLVNITRLSEYRRDAHTQTYKKQWAEPTAEQRADPRSYADCTHWCLPGVPDTWNELLYWKLFFPSNDQFL

SEQ ID NO: 5898 - protein, 388 aa, Saccharum officinarum
MKVLAVLALVAAAAPFLRAAGQGEDGAGPLPFAVGAAPAGCDVAQGEWVRDDDARPLYQEWECPYIQPQLTCQAHGRPDKAYQSWRWQPRGCSLPSFNATLMLEMLRGKRMLFVGDSLNRGQYVSLLCLLHRAIPDGAKSFETVDSLSIFRARDYDATIEFYWAPMLAESNSDDAVVHSADDRLIRGAPMDRHSSFWKGADVLVFNSYLWWVAGDKIQILRGADNDPSKDIVEMKSEEAYRLVLYQVVRWLERNVDAKKSRVFFVTASPTHTEGKAWGDKAEGANCYGQTSPISAASSYQGSTSREMMRVTEEVLATSRVPVGLVNITRLSEYRRDAHTQTYKKQWAEQRADPKSYADCTHWCLPGVPDTWNELLYWKLFFPSNDQFL

SEQ ID NO: 5899 - protein, 390 aa, Panicum virgatum
MKVLAVLALVAAAAPFLGAAGQGDGAGPLPFAVGAAPAGCDIGQGEWVRDEAARPWYQEWECPYIQPQLTCQAHGRPDKGYQNWRWQPRGCSLPSFNATMMLEMLRGKRMLFVGDSLNRGQYVSLLCLLHRAIPDGAKSFETVDSLSIFRAKDYDATIEFYWAPMLAESNSDDAVVHRVDDRVIRGAPMDKHSRFWQGAHILVFNSYLWWTAGDKIKILRGADNDLSKDIVEMKAAEAYRLVLHQVVRWLERNADPKNSRAFFVTASPTHTDSSAWGDETEGGNCYNQTTPIGDASYWGSTSREILRVTEEVLATSRVPIGVVNITQLSEYRRDGHTQTYKKQWAEPTPEQRADPRSYADCTHWCLPGVPDTWNELLYWKLFFPSNDQAL

SEQ ID NO: 5900 - protein, 394 aa, Panicum virgatum
MKVLAVLALVAAAAPFLRAAGQGGEGDDGAGPLPFAVGAAPAGCDIGQGEWVRDEAARPWYQEWECPYIQPQLTCQAHGRPDKGYQNWRWQPRGCSLPSFNATMMLEMLRGKRMLFVGDSLNRGQYVSLLCLLHRAIPDGAKSFETVDSLSIFRAKNYDATIEFYWAPMLAESNSDDAVVHRVDDRVIRGAPMDKHSRFWQGAHILVFNSYLWWTAGDKIKILRGADNDLSKDIVEMKAAEAYRLVLYQVVRWLELNADPKNSRAFFVTASPTHTDSSAWGDETEGGNCYDQTTPIGDASYWGSTSREMLRVTEEVLATSRVPVGVVNITQLSEYRRDGHTQTYKKQWAEPTPEQRADPRSYADCTHWCLPGVPDTWNELLYWKLFFPSNDQAL

SEQ ID NO: 5901 - protein, 169 aa, Oryza sativa
MPRSRINGNFIDKTFSIVANILLRIIPTTSGEKRAFTYYRDGMLAQSEGNYAEALQNYYEAMRLEIDPYDRSYILYNIGLIHTSNGEHTKALEYYFRALERNPFLPQAFNNMAVICHYGEQAILQGDSEIAEAWFDQAAEYWKQAIALTPGNYIEAQNWLKITKRFEFE

SEQ ID NO: 5902 - protein, 169 aa, Oryza sativa
MPRSRINGNFIDKTFSIVANILLRIIPTTSGEKRAFTYYRDGMLAQSEGNYAEALQNYYEATRLEIDPYDRSYILYNIGLIHTSNGEHTKALEYYFRALERNPFLPQAFNNMAVICHYGEQAILQGDSEIAEAWFDQAAEYWKQAIALTPGNYIEAQNWLKITKRFEFE

SEQ ID NO: 5903 - protein, 170 aa, Lolium multiflorum
MPRSRANGNFIDKTFSIVANILLRIIPTTSGEKKAFTYYRDGMLAQSEGNYAEALQNYYEATRLEIDPYDRSYILYNIGLIHTSNGEHTKALEYYFRALERNPFLPQAFNNMAVICHYRGEQAILQGDSEIAEAWFDQAAEYWKQAIALTPGNYIEAQNWLKITKRFEFE

SEQ ID NO: 5904 - protein, 170 aa, Hordeum vulgare
MPRSRVNGNFIDKTFSIIANILLRIIPTTSGEKKAFTYYRDGMLAQSEGNYAEALQNYYEAMRLEIDPYDRSYILYNIGLIHTSNGEHTKALEYYFRALERNPFLPQAFNNMAVICHYRGEQAILEGDSEIAEAWFDQAAEYWKQAIALTPGNYIEAQNWLKITKRFEFE

SEQ ID NO: 5905 - protein, 169 aa, Oryza sativa
MPRSRINGNFIDKTFSIVANILLRIIPTTSGEKRAFTYYRDGMLAQSEGNYAEALQNYYEATRLESDPYDRSYILYNIGLIHTSNGEHTKALEYYFRALERNPFLPQAFNNMAVICHYGEQAILQGDSEIAEAWFDQAAEYWKQAIGLTPGNYIEAQNWLKITKRFEFE

SEQ ID NO: 5906 - protein, 168 aa, Sesamum indicum
MPRSRINGNFIDKTFSIVANILLQIIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIRQGDSEIAEAWFDQAAEYWKQAIALTPGNYIEAHNWLKITRRFE

SEQ ID NO: 5907 - protein, 113 aa, Zostera marina
MPRSRINGNFIDKTFSIVANILLQIIPTTSGEKEAFTYYRDGMSAQSEGNYAEALQNYYEAMRLESDPYDRSYILYNIGLIHTSNGEHTKALEYYFRALERNPFLPQALIIWP

SEQ ID NO: 5908 - protein, 168 aa, Lactuca sativa
MPRSRINGNFIDKTFSIVANILLRIIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIRQGDSEIAEAWFDQAAEYWKQAIALTPGNYIEAHNWLKITRRFE

SEQ ID NO: 5909 - protein, 168 aa, Olea europaea
MPRSRINGNFIDKTFSIVANILLRIIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIRQGDSEIAEAWFDQAAEYWKQAIALTPGNYIEAHNWLKITGRFE

SEQ ID NO: 5910 - protein, 169 aa, Oryza sativa
MPRSRINGNFIDKTFSIVANILLRIIPTTSGEKRAFTYYRDGMLAQSEGNYAEALQNYYEATRLEIDPYDRSYILYNIGLIHTSNGEHTKALEYYFRALERNPFLPQAFNNMAVICHYGEKRPSTGDSEIAEAWFDQAAEYWKQAIALTPGNYIEAQNWLKITKRFEFE

SEQ ID NO: 5911 - protein, 750 aa, Oryza sativa
MMIRSPEPEVKIVVDRDPVKTSFEEWARPGHFSRTIAKGPDTTTWIWNLHADAHDFDSHTGDLEEISRKVFSAHFGQLSIIFLWLSGMYFHGARFSNYEAWLSDPTHIGPSAQVVWPIVGQEILNGDVGGGFRGIQITSGFFQIWRASGITSELQLYCTAIGALIFASLMLFAGWFHYHKAAPKLAWFQDVESMLNHHLAGLLGLGSLSWAGHQIHVSLPINQFLDAGVDPKEIPLPHEFILNRDLLAQLYPSFAEGATPFFTLNWSKYAEFLSFRGGLDPITGGLWLSDIAHHHLAIAILFLIAGHMYRTNWGIGHGLKDILEAHKGPFTGQGHKGLYEILTTSWHAQLSLNLAMLGSTTIVVAHHMYSMPPYPYLATDYGTQLSLFTHHMWIGGFLIVGAAAHAAIFMVRDYDPTTRYNDLLDRVLRHRDAIISHLNWVCIFLGFHSFGLYIHNDTMSALGRPQDMFSDTAIQIQPIFAQWVQNLHAGAPSVTAPGATTSTSLTWGGGELVAVGGKVALLPIPLGTADFLVHHIHAFTIHVTVLILLKGVLFARSSRLIPDKANLGFRFPCDGPGRGGTCQVSAWDHVFLGLFWMYNSISVVIFHFSWKMQSDVWGTISDQGVVTHITGGNFAQSSITINGWLRDFLWAQASQVIQSYGSSLSTYGLFFLGAHFVWAFSLMFLFSGRGYWQELIESIVWAHNKLKVAPATQPRALSIIQGRAVGVTHYLLGGIATTWAFFLARIIAVG

SEQ ID NO: 5912 - protein, 241 aa, Amorphophallus konjac
MIISSPEPEVKILVDRNPVKTSFEEWARPGHFSRTIAKGPDTTTWIWNLHADAHDFDSHTSDLEEISRKVFSAHFGQLSIIFLWLSGMYFHGARFSNYEAWLSDPTHIAPSAQVVWPIVGQEILNGDVGGGFRGIQITSGFFQIWRASGITNELQLYCTAIGALVFAALMLFAGWFHYHKAAPKLAWFQDVESMLNHHLAGLLGLGSLSWADTKSMYLCRLTNFSTLEWILRRYHFLMNLS

SEQ ID NO: 5913 - protein, 743 aa, Tragopogon dubius
MIIRSPEPEVKILVDRDHIKTSFEEWARPGHFSRTIAKGPETTTWIWNLHADAHDFDSHTSDLEEISRKVFSAHFGQLSIIFLWLSGMYFHGARFSNYEAWLSDPTHIGPSAQVVWPIVGQEILNGDVGGGFRGIQITSGFFQIWRASGITSELQLYCTAIGGLIFAALMLFAGWFHYHKAAPKLAWFQDVESMLNHHLAGLLGLGSLSWAGHQVHVSLPINQFLNAGVDPKEIPLPHEFILNRDLLAQLYPSFAEGATPFFTLNWSKYADFLTFRGGLDPVTGGLWLTDTAHHHLAIAILFLIAGHMYRTNWGIGHGLKDILEAHKGPFTGQGHKGLYEILTTSWHAQLALNLAMLGSLTIVVAHHMYAIPYLATDYGTQLSLFTHHMWIGGFLIVGAAAHAAIFMVRDYDPTTRYNDLLDRVLRHRDAIISHLNWACIFLGFHSFGLYIHNDTMSALGRPQDMFSDTAIQLQPVFAQWIQNTHALAPGATAPGATASTSLTWGGGDLVAVGGKVALLPIPLGTADFLVHHIHAFTIHVTVLILLKGVLFARSSRLIPDKANLGFRFPCDGPGRGGTCQVSAWDHVFWMYNAISVVIFHFSWKMQSDVWGSISDQGVVTHITGGNFAQSSITINGWLRDFLWAQASQVIQSYGSSLSAYGLFFLGAHFVWAFSLMFLFSGRGYWQELIESIVWAHNKLKVAPATQPRALSIVQGRAVGVTHYLLGGIATTWAFFLARIIAVG

SEQ ID NO: 5914 - protein, 168 aa, Panax ginseng
MPRSRINGNFIDKTFSIVANILLRIIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIRQGDSEIAEAWFDQAAEYWKQAMALTPGNYIEAHNWLKITRRFE

SEQ ID NO: 5915 - protein, 168 aa, Populus trichocarpa
MPRSRITGNLIDKTFSIVANILLRIIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIRQGDSEIAEAWFDQAAEYWKQAIALTPGNYIEAQNWLKITRRFE

SEQ ID NO: 5916 - protein, 168 aa, Guizotia abyssinica
MSRSRINGNFIDKTFSIVANILLRIIPTTSGEKEAFTYYRDGMSAQSEGNYAEALQNYYEAMRLEVDPYDRSYILYNIGLIHTSNGEHTKALEYYFRALERNPFLPQAFNNMAVICHYRGEQAIRQGDSEIAEAWFDQAAEYWKQAIALTPGNYIEAHNWLKITRRFE

SEQ ID NO: 5917 - protein, 168 aa, Pisum sativum
MTRSRINGNFIDKTFTIVANILLRIIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIRQGDSEIAESWFDQAAEYWKQAIALTPGNYIEAQNWLKITGRFE

SEQ ID NO: 5918 - protein, 168 aa, Vigna unguiculata
MPRSRINENFIDKTFSIVANILLRIIPTTSGEKRAFTYYRDGMSAQSEGNYAEALQNYYEAMRLEIDPYDRSYILYNIGLIHTSNGEHTKALEYYFRALERNPFLPQAFNNMAVICHYRGEQAIRQGDSEVAESWFNQAAEYWKQAIALTPGNYIAAQNWLKITGRFE

SEQ ID NO: 5919 - protein, 168 aa, Cicer arietinum
MTRSRINGNFIDKTFSIVANILLRIIPTTSGEKEAFSYYRDGMSAQSEGNYAEALENYYEAMRLEIDPYDRSYILYNIGLIHTSNGEHTKALEYYFRALERNPFLPQAFNNMAVICHYRGEQAIRQGDSEIAESWFDQAAEYWKQAIALTPGNYIEAQNWLKITGRFE

SEQ ID NO: 5920 - protein, 168 aa, Unknown
  Sequence found in Organisms: Solanum tuberosum, Solanum phureja
MPRSRTNGNFIDKTFSIVADILLRVIPTTSGEKEAFTYYRDGMSAQSEGNYAEALQNYYEAMRLEIDPYDRSYILYNIGLIHTSNGEHTKALEYYFRALERNPFLPQAFNNMAVICHYRGEQAIQQGDSEIAEAWFDQAAEYWKQAIALTPGNYIEAHNWLKITRRFE

SEQ ID NO: 5921 - protein, 168 aa, Plantago ovata
MSRSRTNGNFIDKTFSIVANILLQIIPTTSGEKEAFTYYRDGMSAQSEGNYAEALQNYYEAMRLEMDPYDRSYILYNIGLIHTSNGEHTKALEYYFRALERNPFLPQAFNNMAVICHYRGEQAVREGDSEIAEAWFDQAAEYWKQAIALTPGNYIEAHNWLKITRRFE

SEQ ID NO: 5922 - protein, 168 aa, Coffea canephora
MPRSQINGNFIDKTFSIVANILLRIIPTTSGEREAFTYYRDGMSAQSEGNYAEALQNYYEAMRLEIDPYDRSYILYNIGLIHTSNGEHTKALEYYFRALERNPFLPQAFNNMAVICHYRGEQAIRQGDSEIAEAWFDQAAEYWKQAISLTPGNYIEAHNWLKITGRFG

SEQ ID NO: 5923 - protein, 161 aa, Cajanus cajan
MPRSRINGNFIDKTFSIVANILLRIIPTTSGEKEAFTYYRDAQSEGNYAEALQNYYEAMRLEIDPYDRSYILYNIGLIHTSNGEHTKALEYYFRALERNPFLPQAFNNMAVICHYAIRQGDSEIAEAWFDQAAEYWKQAIALTPGNYIEAQNWLKITGRFE

SEQ ID NO: 5924 - protein, 750 aa, Arabidopsis thaliana
MIIRSPEPEVKILVDRDPIKTSFEEWAKPGHFSRTIAKGPDTTTWIWNLHADAHDFDSHTSDLEEISRKVFSAHFGQLSIIFLWLSGMYFHGARFSNYEAWLSDPTHIGPSAQVVWPIVGQEILNGDVGGGFRGIQITSGFFQIWRASGITSELQLYCTAIGALVFAALMLFAGWFHYHKAAPKLAWFQDVESMLNHHLAGLLGLGSLSWAGHQVHVSLPINQFLNAGVDPKEIPLPHEFILNRDLLAQLYPSFAEGATPFFTLNWSKYSEFLTFRGGLDPVTGGLWLTDIAHHHLAIAILFLIAGHMYRTNWGIGHGIKDILEAHKGPFTGQGHKGLYEILTTSWHAQLSLNLAMLGSLTIIVAHHMYSMPPYPYLATDYATQLSLFTHHMWIGGFLIVGAAAHAAIFMVRDYDPTNRYNDLLDRVLRHRDAIISHLNWVCIFLGFHSFGLYIHNDTMSALGRPQDMFSDTAIQLQPVFAQWIQNTHALAPGVTAPGETASTSLTWGGGELVAVGGKVALLPIPLGTADFLVHHIHAFTIHVTVLILLKGVLFARSSRLIPDKANLGFRFPCDGPGRGGTCQVSAWDHVFLGLFWMYNAISVVIFHFSWKMQSDVWGSISDQGVVTHITGGNFAQSSITINGWLRDFLWAQASQVIQSYGSSLSAYGLFFLGAHFVWAFSLMFLFSGRGYWQELIESIVWAHNKLKVAPATQPRALSIIQGRAVGVTHYLLGGIATTWAFFLARIIAVG

SEQ ID NO: 5925 - protein, 161 aa, Lactuca sativa
MPRSRINGNFIDKTFSIVANILLRIIPTTSGEKEAFTYYRDAQSEGNYAEALQNYYEAMRLEIDPYDRSYILYNIGLIHTSNGEHTKALEYYFRALERNPFLPQAFNNMAVICHYAIRQGDSEIAEAWFDQAAEYWKQAIALTPGNYIEAHNWLKITRRFE

SEQ ID NO: 5926 - protein, 157 aa, Medicago truncatula
MTRSRINGNFIDKTFTIVANILLRIIPTTSGEKEAFTYYRDGNYAEALQNYYEAMRLEIDPYDRSYILYNIGLIHTSNGEHTKALEYYFRALERNPFLPQAFNNMAVICHYAIRQGDSEIAESWFDQAAEYWKQAIALTPGNYIEAQNWLKITGRFE

SEQ ID NO: 5927 - protein, 170 aa, Unknown
  Sequence found in Organisms: Amborella trichopoda, Cannabis sativa
MSRSRINGNFIDKTFSIVANILLRIIPTTSGEKEAFAYYRDGNYAEALQNYYEAMRLEIDPYDRSYILYNIGLIHTRNGEHTKALEYYFRALERNPFLPQAFNNMAVICHYGRNLSAYSDRGEQAIRQGDSEIAEAWFDQAAEYWKQALALTPGNYIEAQNWLKITRRFE

SEQ ID NO: 5928 - protein, 63 aa, Ricinus communis
MPRSQITGNFIDKTFSIVANILLQIILKTLGEKEAFTYYRDGYLLNLKEITQKLYRIIMKLCN

SEQ ID NO: 5929 - protein, 56 aa, Medicago truncatula
MTRSRINGNFIDKTFTIVANILLRIIPTTSGEKEAFTYYRDDSLNRMTTVTDVGSI

SEQ ID NO: 5930 - protein, 169 aa, Pinus taeda
MPRSQRNDNFIDKTFTIVADILLRIIPMAPGEKEAFTYYRDGMSAQSEGEYAEALQNYYEAMRLETDPYDRSYILYNIGLVHTSNGEHTKALEYYFQALERNPSLPQALNNTALICHYRGEQAIRQGDPETAEAWFDQAAEYWEQAIALAPGNYIEAQNWLKITGRFGE

SEQ ID NO: 5931 - protein, 139 aa, Ricinus communis
MPRSQITGNFIDKTFSIVANILLQIILKTLGEKEAFTYYRDVFAQSEGNYAKALQNYYEAMQLEIDPYDRSYILYNIGLIHTSNGEHTKALEYYFWALERNPFLPQALNNMVVICHYAIRQGDSKIVEAWFDQAAEYWK

SEQ ID NO: 5932 - protein, 170 aa, Cannabis sativa
MSRSRINGNFIDKTFSIVANILLRISPTTSGEKEAFAYYRDGNYAEALQNYSEAMRLEIDPYDRSYILYNIGLIHTRNGEHTKALEYYFRALERNPFLTQAFNNMAVICHYGRNLSAYSDRGEQAIRQGDPEIAEAWFDQAAEYWKQALALTPGNYIEAQNWLKITRRFE

SEQ ID NO: 5933 - protein, 85 aa, Beta vulgaris
MRLEIDPYDRSYILYNIGLIHTSNGEHTKALEYYFRALERNPFLPQAFNNMAVICHYRGEQAIQQGDSQIAEALFDQAAEYSNKL

SEQ ID NO: 5934 - protein, 170 aa, Cedrus atlantica
MPRSQRNDNFIDKTFTIIADILLRIIPMAPGEKEAFTYYRDGVMSAQSEGEYAEALQNYYEAMRPETDPYDRSYILYNIGLVHTSNGEHTKALEYYFQALERNPSLPQALNNTALICHYRGEQAIRQGDPETAEAWFDQAAEYWEQAIALAPGNYIEAQNWLKITGRFGE

SEQ ID NO: 5935 - protein, 62 aa, Ricinus communis
LFKMPCDLQPILQFNIIFGSKRYSLFPILCGLIEPSLYNFRISLPNGLFSLSHVMTDHDHII

SEQ ID NO: 5936 - protein, 64 aa, Citrus clementina
LFETSRDLQPILRLNIITRSKRNSLFPILGSLIEPSLRNFRISLSNGLFPPVMIDHNHIIKNLW

SEQ ID NO: 5937 - protein, 273 aa, Panicum virgatum
  misc_feature (51)..(51): Xaa can be any naturally occurring amino acid
  misc_feature (54)..(54): Xaa can be any naturally occurring amino acid
  misc_feature (99)..(99): Xaa can be any naturally occurring amino acid
  misc_feature (106)..(106): Xaa can be any naturally occurring amino acid
  misc_feature (171)..(171): Xaa can be any naturally occurring amino acid
MTVSPPSPLLPPAGEPFRVFVGYDPREHEAYEVCRRSLLRHASIPLDVRPXRQXDLRAAGLYWRARGPTESTEFSFTRFLTPYLAGYRGWALFVDCDFXYLADLAXLLAAAAPPGADAARLAVACVKHEYQPAEATKMDGAIQTVYPRKNWSSMVLYNCAHPKNVAALTPXAVSTQTGAFLHRFAWLDDDEIGEVPFVWNFLVGHNRVDPADPDTRPRAIHYTCGGPWFERYRDCEFADLWIKEAEELRAEKEKLKLLEDKDADEEAKNKEGN

SEQ ID NO: 5938 - protein, 280 aa, Setaria italica
MSPAPPPSPLLPPAGEPFRVFVGYDPREHEAYEVCRRSLLRHATMPLDVRPVRQPDLRAAGLYWRARGPTESTEFSFTRFLTPYLAGYRGWALFVDCDFLYLADVADLLAAAAPPGADADRLAVACVKHVYEPAEATKMDGAIQTTYPRKNWSSMVLYNCAHPKNVAALTPDAVSTQTGAFLHRFAWLNDDEIGEVPFVWNFLVGHNRVDPADPATHPRAIHYTCGGPWFERYRDCEFADLWIKEAEELKAEKDKLEDGEKLKLIEDKDAKEQDDNKEEN

SEQ ID NO: 5939 - protein, 170 aa, Saccharum officinarum
MGYLNHGRSLPLLLCLHLLLPLLPFATADIASEKQALLAFASAVYRGNKLNWSQNIPLCSWHGVTCSPDRSRISALRVPGAGLIGTIPANTLGRLVFLQVLSLRSNRLSGSLPYDVASLSSLQAIFLQHNELSGDLPPFLSPNLIPLISLTTPLQDKSHQVCRILPNYLS

SEQ ID NO: 5940 - protein, 636 aa, Sorghum bicolor
MGDLNHGSSLPLLLCLHLLLPLLPFAMADIASEKQALLAFASAVYRGNKLNWSQNIPLCSWHGVICSPDRSRILALRVPGAGLIGTIPANTLGRLVFLQVLSLRSNRLSGSLPYDVASLPSLQAIFLQHNELSGDLPPFLSPNLNTLDLSYNSFTGEIPPGLQNLTKLSILNLAGNSLSGPIPDLKLPSLRQLNLSNNELNGSIPPFLQIFSNSSFLGNSGLCGPPLPECSFLSSPTPSQVPSPSKLPHHEKKAGNGLVIAAVAGSFVILLLAAVMFTMCISKRKEKKDEVGYNGKVTDGLRIEKRKEDVSSGVQMAHKNKLVFLEGCSYNFDLEDLLRASAEVLGKGSYGTAYKAILEDSTSVVVKRLKDVVAGKKEFEQQMELIGRVGKHANIAPIRAYYYSKDEKLVVYEYIATGSFSALLHGIKGVCEKTPLDWNTRMKIILGTARGIEHIHSEGGSKFAHGNIKSTNVLLDQERNPYVSDYGLSSLMSLPINTSRVGTGYRAQETFESRKFTHKSDVYSFGVLLMEMLTGKAPLQSQGQDDVAIDLPRWVHSVVREEWTAEVFDVQLMKYPNIEDELVQMLHIAMACTAWSPDRRPTMAEVIRMMEELRRPASESRTPSIGNPKESSPLSA

SEQ ID NO: 5941 - protein, 319 aa, Panicum virgatum
MGHLNYGVSLPLLLRLQLLLPLLLPFAMADIASEKQALLDFASAVYRGNKLNWSPNIPLCSWHGVTCSPDRSHIWALRVPGAGLIGTIPANTLGRLVSLQVLSLRSNRLSGSLPLDVASLPSLQAIFLQHNELLGDLPSFFSPSLNTLDLSYNSFTGQIPSGLQNLTQLSILNLAGNSLSGPIPDLKLPSLRQLNLSNNELNGSIPPFLQIFSNSSFLDNPGLCGPPLAECSFLSSPTPSQVPLLPSSPHHEKKTCNGMIIAAVVGGFVIFLLAAVMFTMCFSKRKDKKDEVAYNSKVTDGARIEKRKEDVSSGCPNGS

SEQ ID NO: 5942 - protein, 145 aa, Setaria italica
MDHLNHESYFPLLLCLHLLLLLLLPFAMADIASEKQALLAFASAVYHGNKLNWGPNIPLCSWHGVTCSPDRSRIWALRVPGAGLIGTIPANTLGRLASLQVLSLRSNRLSGSLPSDVASLPSLQATFLQHNELSGDLPSFFSPKP

SEQ ID NO: 5943 - protein, 393 aa, Avena sativa
MPGLTAPSDYAEEPPRHPDLRINSKEPFNAEPHRSALVSSYVTPVDFFYKRNHGPIPKIDDISRYSVSINGLVNKHIQLSMADIRLLPKYNVTATLQCAGNKRTAMSKVRKVRGVGWDVSALGNATWGGAKLSDVLELVGIPKLSSVTALGGKHVEFVSVDRCKEEKGGPYKASIPLKQATDPDADVLLAYEMNGEIINRDHGYPLRVVVPGVIGARSVKWLDSISIIKEECQGFFMQKDYKMFPPTVDWDNIDWSTRRPQMDFPVQSAICTLEDVDVIKEGKARIAGYAVSGGGRGIERVDISVDGGKTWVEAHRYQKSSVPYISDGPQSDKWAWVLFEATLDVPANAEIVAKAVDSAANIQPEKVEDIWNLRGILNTSWHRIKIQNSRSKM

SEQ ID NO: 5944 - protein, 397 aa, Brachypodium distachyon
MPGLTAPSGYAEEPPRHPALRINSKEPFNAEPHRSALVSSYVTPVDFFYKRNHGPIPKVDDISRYSVSINGLVSNHMQLFMADIRMLPKYNVTATLQCAGNKRTAMSKVRKVRGVGWDVSALGNATWGGAKLADVLELAGIPKLSSVTSLGGKHVEFVSVDRCKEEKGGPYKASIPLKQATDPDADVLLAYEMNGETINRDHGYPLRVVVPGVIGARSVKWLDSINLIEEECQGFFMQKDYKMFPPTVDWDNIDWSTRRPQMDFPVQSAICTLEDVDVIKEGKARIAGYAVSGGGRGIERVDVSVDGGKTWVEAHRYQKSNVPYVSDRAQSDKWAWVLFEATLDIPANAEIVAKAVDSAANIQPEKVEDIWNLRGILNTSWHRIKIQNSLCAARSNM

SEQ ID NO: 5945 - protein, 569 aa, Pennisetum glaucum
MDLHQLLKYRLTGANFFYEFPTENSLASNPWPATPLKSEFSNSLYSPLSTQLECDNSSAISNPPDNQSSTETISAQPISPLEVDSSNRQAGILWENTQVRPDQLYTTSRHNMQHALREIETVLMAPDADDAATSTKHEFEEHKHAPLMRQRSRTWSHESRQPSPGVVRTQLHLDTPQQAMNSARKRQRELREDPQSMVKQLLTKCAEALSEERIEEFLKLVQQARGVVSITGEPIQRLGAYLLEGLVARHGNSGTNIYRALKCREPESNELLSYMKILYTICPYFKFGYMAANGAIAEALRNEDKIHIIDFQIAQGTQWITLIQALAARPGGPPHVRITGIDDPVSEYARGEGLDLVGKMLKSMSEEFRIPLEFTPLPGVYATQVTKEMLDIRPGEALAVNFTLQLHHTPDESVDVNNPRDGLLRMVKGLSPKVTTLVEQESHTNTTPFLMRFSETMDYYSAMFESIDANLPRDNKERINVEQHCLAKDIVNIIACEGKDRVERHELLGKWKSRLTMAGFKPYPLSSYVNSVIRKLLGCYSDKYTLEEKDGAMLLGWKSRKLISASAWH

SEQ ID NO: 5946 - protein, 210 aa, Saccharum officinarum
MARLLLLAAAAAAFLAASAASPVASDFIRKSCRATQYPSVCEQSLASYGGSPPPRSPRELARAALSVSADRARAASAYVGRLCGGSGSGGSRGAGAKGAKKGSGSAASAAGPVRDCLENLADSVGHLRDAAQEMGGAGMSRAGTPAFKWHLSNVQTWCSAALTDENTCLDGLSARGVDAGTRAAIRGKVVEVAQVTSNALALVNKVGPGY

SEQ ID NO: 5947 - protein, 661 aa, Sorghum bicolor
MSLDSEASSQGGDYRSFRQITRDRLLFEMLRSTRKNSKSTWKVLIMDKFTVKIMSYACKMADITEEGVSLVEDLYKRRQPLPSLDAIYFIQPTKENIVMFLSDMSGRSPLYKKAYVFFSSPVHKELVAQIKKDSSVLPRIAALSEMNLEYFAIDSQGFTTDHERALEELFSENAEGSHKYNACLNTMATRISTVFASMREFPRVHYRVAKTIDASTMTTLRDLIPTKLAASVWNCLAKYKTTVPEFPQTETCELLIVDRSLDQIAPIIHEWTYDAMCHDLLCMDGNKYVHEVPTKNGSATEKKEVLLEDHDPVWLELRHAHIADASERLHDKMTNFISKNKAAQLHQARTGGELSTRDLQKMVQALPQYNDQIDKLSLHVEIAGKLNNIIREQCLRDVGQLEQDLVFGDAGTKELINFLRTQLVVSRENKLRLLMIYAALNPEKFESDKGAKLMQLAGLSADDMIAVNNMRCLCGPDTKKSSVGGFALKFDVHKKKHAHRKERTGEESAWALSRFYPILEELIEKLSKGELPKDEYNCMNDPSPSAHGPPTSSSARSSPAHSMRSRRTGGTWARPRGSDDGYSSDSVLKHASSDFRKLGQRIFVFVIGGATRSELRAAHKLSSKLKRDIILGSSSLDDPPQFITKLKLMSAEELTLDDLQL

SEQ ID NO: 5948 - protein, 660 aa, Setaria italica
MSLDSDTSSQGGDHRSFRHITRDRLLFEMLRSTRKNSKSTWKVLIMDKFTVKIMSYACKMADITEEGVSLVEDLYKRRQPLPSLDAIYFIQPTKENIVMFLSDMSGRSPLYKKAYVFFSSPVHKELVAQIKKDSSVLPRIGALSEMNLEYFAIDSQGFTTDHERALEELFSENAEGSHKYNACLNTMATRISTVFASMREFPRVHYRVAKTIDASTMTTLRDLVPTKLAAGVWNCLAKYKTTIPEFPQTETCELLIVDRSIDQIAPIIHEWTYDAMCHDLLCMDGNKYVHEVPSKNGSATEKKEVLLEDHDPIWLELRHAHIADASERLHDKMTNFVSKNKAAQLHQARNGGEVSTRDLQKMVQALPQYSDQIDKLSLHVEIAGKLNNIIREQCLRDVGQLEQDLVFGDAGTKELINFLRTQLGVSRENKLRLLMIYAALNPEKFESDKGAKLMQLAGLSVDDMIAVNNMRCLCGPDTKKSSGGGFTLKFDVHKKKHAHRKERTWEESAWALSRFYPVLEELIEKLSKGELPKDEYNCMNDPSPSAHGVPTSSSVRTSPAHSMRSRRTGGTWARPRGSDDGYSSDSVLKHASSDFKKLGQRIFVFVIGGATRSELRAAHKLSSKLKREVILGSSSLDDPPQFITKLKLMSAELSLDDLQI

SEQ ID NO: 5949 - protein, 661 aa, Pennisetum glaucum
MSLDSDTSSQGGDHRSFRQITRDRLLFEMLRSTRKNSKSTWKVLIMDKFTVKIMSCACKMADITEEGVSLVEDLYKRRQPLPSLDAIYFIQPTKENIVMFLSDMSGRSPLYKKAYVFFSSPVHKELVAQIKKDSSVLPRIGALSEMNLEYLAIDSQGFTTDHERALEELFSENAEGSHKYNACLNTMATRISTVFASMREFPRVHYRVAKTIDASTMTTLRDLVPTKLAAGVWNCLAKYKTKLPEFPQTETCELLIVDRSIDQIAPIIHEWTYDAMCHDLLCMDGNKYVHEVPSKNGSATEKKEVLLEDHDPIWLELRHAHIADASERLHDKMTNFVSKNKAAQLHQARNGGEVSTRDLQKMVQALPQYSDQIDKLSLHVEIAGKLNSIIREQCLRDVGQLEQDLVFGDASTKELINFLRTQLGVSRENKLRLLMIYAALNPDKFESDKGAKLMQLAGLSADDMIAVNNMRCLCGPDTKKSSGGGFTLKFDVHKKKHAHRKERTGEESAWALSRFYPVLEELIEKLSKGELPKEEYNCMNDPSPSAHGLPTSSSVRTSPAHSMRSRRTGGTWARPRGSDDGYSSDSVLKHASSDFKKLGQRIFVFVIGGATRSELRAAHKLSSKLKREVILGSSSLDDPPEFITKLKLMSAEELSLDDLQI

SEQ ID NO: 5950 - protein, 663 aa, Brachypodium distachyon
MSLDSDSSSQGGDNRSFRQITRDRLLFEMLRSTRKDSKSAWKVLIMDKFTVKIMSYSCKMADITEEGVSLVEDLYKRRQPLPSLDAIYFIQPTKENIVMFLSDMSGRSPLYKKAFVFFSSPIQKDLVAQIKKDSSVLPRIGALSEMNLEYIPIESQGFVTDHERALEELFCESAEGFNKYNACLNAMATRISTVFASMREFPRVHYRVAKTIDASTMTTLRDMVPTKIAAGVWNYLSKYKTSIPEFPQTETCELLIVDRSVDQIAPIIHEWTYDAMCHDLLCMDGNKYVHEIPSKNGSASEKKEVLLDDHDPVWLELRHAHIADASERLHDKMTHFVSKNKAAQLHQARTGGELSTRDLQKMVQALPQYSDQIDKLSLHVEIAGKLNSIIREQCLRDVGQLEQDLVFGDAGTKELINFLRTQLGVSRENKLRLLMIYAAINPEKFESDKGTKLMQLAGLSADDMIAVNNMRSLCSDTKKPSGGGFTLKFDVHKKKHGYRKERTGEESAWALSRFYPVLEELIEKLSKGELPKDEYNCMNDPSPSFHGLPTTTTSSSARTSPAHSMRSRRTGGSWARPRGSDDGYSSDSVLKHASSDFKKRGQRIFVFVIGGATRSELRAAHKLTSKLKREVILGSSSLDDPPQFITKLKMMSAEELTLDDLQI

SEQ ID NO: 5951 - protein, 662 aa, Triticum aestivum
MSLDSDSSSQGGDRRSFRQITRDRLLFEMLRSTRKDSKSAWKVLIMDKFTVKIMSYSCKMADITEEGVSLVEDLYKRRQPLPSLDAIYFIQPTKENVVMFLSDMSGRSPLYKKAYVFFSSPIQKDLVAQIKRDSSILPRIGALSEMNLEYFPIDSQGFITDHERALEELFCESAEGFNKYNACLNAMATRISTVFASMREFPRVHYRIAKTIDASTMTTLRDMVPTKIAAGVWNYLSKYKTSIPEFPQTETCELLIVDRSVDQIAPIIHEWTYDAMCHDLLCMDGNKYVHEVSSKNGSASEKKEVLLEDHDPVWLELRHSHIADASERLHDKMTHFVSKNKAAQLQQARTGGELSTRDLQKMVQALPQYTDQIDKLSLHVEIAGKLNVIIREQCLRDVGQLEQDLVFGDAGTKELINFFRTQLGVSRENKLRLLMIYAAINPEKFESDKGTKMMQLAGLSADDMIAVNNMRCLCTDTKKSSGGGFTLKFDVQKKKHAHRKERTTEQSAWALSRFYPVLEELIEQLSKGELPKDEYNCMNDPSPSFHVVPTTTSTSARTSPAHSMRSRRTGGSWARPRGSDDGYSSDSVLKHASSDFQKHGQRIFVFVIGGATRSELRAAHKLSSKLKREVILGSSSLDDPPQFITKLKMMSAEELTLDDLHI

SEQ ID NO: 5952 - protein, 662 aa, Triticum aestivum
MSLDSDSSSQGGDRRSFRQITRDRLLFEMLRSTRKDSKSAWKVLIMDKFTVKIMSYSCKMADITEEGVSLVEDLYKRRQPLPSLDAIYFIQPTKENVVMFLSDMSGRSPLYKKAYVFFSSPIQKDLVAQIKRDSSILPRIGALSEMNLEYFPIDSQGFITDHERALEELFCESAEGFNKYNACLNAMATRISTVFASMREFPRVHYRIAKTIDASTMTTLRDMVPTKIAAGVWNYLSKYKTSIPEFPQTETCELLIVDRSVDQIAPIIHEWTYDAMCHDLLCMDGNKYVHEVSSKNGSASEKKEVLLEDHDPVWLELRHSHIADASERLHDKMTHFVSKNKAAQLQQARAGGELSTRDLQKMVQALPQYTDQIDKLSLHVEIAGKLNVIIREQCLRDVGQLEQDLVFGDAGTKELINFFRTQLGVSRENKLRLLMIYAAINPEKFESDKGTKMMQLAGLSADDMIAVNNMRCLCTDTKKSSGGGFTLKFDVQKKKHAHRKERTTEQSAWALSRFYPVLEELIEQLSKGELPKDEYNCMNDPSPSFHVGPTTTSTSARTSPAHSMRSRRTGGSWARPRGSDDGYSSDSVLKHASSDFQKHGQRIFVFVIGGATRSELRAAHKLSSKLKREVILGSSSLDDPPQFITKLKMMSAEELTLDDLHI

SEQ ID NO: 5953 - protein, 662 aa, Secale cereale
MSLDSDSSSQGGDRRSFRQITRDRLLFEMLRSTRKDSKSAWKVLIMDKFTVKIMSYSCKMADITEEGVSLVEDLYKRRQPLPSLDAIYFIQPTKENVVMFLSDMSGRSPLYKKAYVFFSSPIQKDLVAQIKRDSSILPRIGALSEMNLEYFPIDSQGFITDHERALEELFCESAEGFDKYNACLNAMSTRISTVFASMREFPRVHYRIAKTIDASTMTTLRDMVPTKIAAGVWNYLSKYKTSIPEFPQTETCELLIVDRSVDQIAPIIHEWTYDAMCHDLLCMDGNKYVHEVSSKNGSASEKKEVLLEDHDPVWLELRHSHIADASERLHDKMTHFVSKNKAAQVHQARTGGELSTRDLQKMVQALPQYTDQIDKLSLHVEIAGKLNAIIREQCLRDVGQLEQDLVFGDAGTKELINFFRTQLGVSRENKLRLLMIYAAINPEKFESDKGTKMMQLAGLSADDMIAVNNMRCLCADTKKSSGGGFTLKFDVQKKKHAHRKERTTEQSAWALSRFYPVLEELIEQLSKGELPKDEYNCMNDPSPSFHVVPTTTSTSARTSPAHSMRSRRTGGSWARPRGSDDGYSSDSVLRHASSDFQKHGQRIFVFVIGGATRSELRTAHKLTSKLKREVILGSSSLDDPPQFITKLKMMSAEELTLDDLHI

SEQ ID NO: 5954 - protein, 665 aa, Oryza sativa
MSMDSDTSSQGGDHRSFRQITRDRLLFEMLRSTRKHSKSTWKVLIMDKLTVKIISCSCKMADITEEGVSLVEDLYKRRQPLPSLDAIYFIQPTKENIGMFLNDMSGRNPLYKKAYVFFSSPIQKELVTQIKKDSSVLPRIGALSEMNLEYFAIDSQGFTTDHERALEELFSENALDSHKYNACLNTMATRISTVFASMREFPRVHYRVAKTIDASVTTTLRDLVPTKLAAAVWNCLSKLKTSIPDYPQTETCELLIVDRSVDQIAPIIHEWTYDAMCHDLLCMDGNKYVHEVPSKNGSSTEKKDVLLEDHDPIWVELRHAHIADASERLHDKMSNFVSKNKAAQLQQARTGGEISNRDLQKMVQALPQYSDQIEKLSLHVEIAGKLNSIIREQGLRDVGQLEQDLVFGDAGTKELINFLRTQLGVSRENKLRLLMIYAAINPDKFESDKGEKLMQLAGLSTDDMIAVSNMRCLCGPDTKKSSGGGFTFKFDVHKKKHGLRKERTGEESTWALSRFYPVLEDLIEKLSKGELPKDEYYCMNDPSPSFHGLPMSSSVRTSPAHQPAHSMRSRRTGGTWARPRGSDDGYSSDSVLKHSSSDFKKLGQRIFVFVIGGATRSELRAVHKLTSKLKREVILGSSSLDDPPQFITKLKMMSVDELTLDDLQI

SEQ ID NO: 5955 - protein, 662 aa, Hordeum vulgare
MSLDSDSSSQGGHRRSFRQITRDRLLFEMLRSTRKGSKSAWKVLIMDKFTVKIMSYSCKMADITEEGVSLVEDLYKRRQPLPSLDAIYFIQPTKENVVMFLSDMSGRSPLYKKAYVFFSSPIQKDLVAQIKRDSSILPRIGALSEMNLEYFPIDSQGFITDHERALEELFCESAEGFNKYNACLNAMATRISTVFASMREFPRVHYRIAKTIDASTMTTLRDMVPTKIAAGVWNYLSKYKTSIPEFPQTETCELLIVDRSVDQIAPIIHEWTYDAMCHDLLCMDGNKYVHEVSSKNGSASGNKEVLLEDHDPVWLELRHSHIADASERLHDKMTHFVSKNKAAQLHQVRTGGELSTRDLQKMVQALPQYTDQIDKLSLHVEIAGKLNAIIREQCLRDVGQLEQDLVFGDAGTKELINFFQTQLGVSRENKLRLLMIYAAINPEKFENDKGTKMMQLAGLSADDMIAVNNMRCLCADTKKSSGGGFTLKFDVQKKKHAHRKERTMEQSAWALSRFYPVLEELIEQLSKGELPKDEYNCMNDPSPSFHVVPTTTSTSARTSPAHSMRSRKTGGSWARPRGSDDGYSSDSVLKHASSDFQKHGQRIFVFVIGGATRSELRAAHKLTSKLKREVILGSSSLDDPPQFITKLKMMSAEELTLDDLHI

SEQ ID NO: 5956 - protein, 386 aa, Oryza sativa
MSMDSDTSSQGGDHRSFRQITRDRLLFEMLRSTRKHSKSTWKVLIMDKLTVKIISCSCKMADITEEGVSLVEDLYKRRQPLPSLDAIYFIQPTKENIGMFLNDMSGRNPLYKKAYVFFSSPIQKELVTQIKKDSSVLPRIGALSEMNLEYFAIDSQGFTTDHERALEELFSENALDSHKYNACLNTMATRISTVFASMREFPRVHYRVAKTIDASVTTTLRDLVPTKLAAAVWNCLSKLKTSIPDYPQTETCELLIVDRSVDQIAPIIHEWTYDAMCHDLLCMDGNKYVHEVPSKNGSSTEKKDVLLEDHDPIWVELRHAHIADASERLHDKMSNFVSKNKAAQLQQARTGGEISNRDLQKMVQALPQYSDQIEKLSLHVEVNSIA

SEQ ID NO: 5957 - protein, 599 aa, Setaria italica
DITEEGVSLVEDLYKRRQPLPSLDAIYFIQPTKENIVMFLSDMSGRSPLYKKAYVFFSSPVHKELVAQIKKDSSVLPRIGALSEMNLEYFAIDSQGFTTDHERALEELFSENAEGSHKYNACLNTMATRISTVFASMREFPRVHYRVAKTIDASTMTTLRDLVPTKLAAGVWNCLAKYKTTIPEFPQTETCELLIVDRSIDQIAPIIHEWTYDAMCHDLLCMDGNKYVHEVPSKNGSATEKKEVLLEDHDPIWLELRHAHIADASERLHDKMTNFVSKNKAAQLHQARNGGEVSTRDLQKMVQALPQYSDQIDKLSLHVEIAGKLNNIIREQCLRDVGQLEQDLVFGDAGTKELINFLRTQLGVSRENKLRLLMIYAALNPEKFESDKGAKLMQLAGLSVDDMIAVNNMRCLCGPDTKKSSGGGFTLKFDVHKKKHAHRKERTWEESAWALSRFYPVLEELIEKLSKGELPKDEYNCMNDPSPSAHGVPTSSSVRTSPAHSMRSRRTGGTWARPRGSDDGYSSDSVLKHASSDFKKLGQRIFVFVIGGATRSELRAAHKLSSKLKREVILGSSSLDDPPQFITKLKLMSAELSLDDLQI

SEQ ID NO: 5958 - protein, 667 aa, Sorghum bicolor
MSIDSDSSSQSGADYRSFRQITRDRLLVEMLRSTRKSSKSTWKVLIMDKLTVKIMSFSCKMADITEEGVSLVEDLYKRRQPLPSMDAIYFMQPTKENVRIFMSDMSGKNSLYKKAYVFFSSPVQRELVAHIKKDSTVLTRISALSEMNLEYFAIDSQGFITDHDKALEELFSEDAEGSHKYNACLNTMATRIATVFASLREFPRVHYRVARTIDASTLTTLRDLVPTKLAASVWNSLARYKSTIPEFPQTETCELLIVDRSIDQIAPIIHEWTYDAMCHDLLYMDGNKYVQEVPSKNGSANEKKEVLLEDHDPVWLELRHAHIADANERLYEKMTSFVSKNKAAQLQQARSGGELSTKQLQKMVQALPQYSDQIDKLTLHVEIAGKLNNIIKEQHLKDVGQLEQDLVFGDAGTKELISFLRTRMDVSRENKLRLLMIYASINPEKFFESDKGAKLMQLAGLSADDMIVVNNMRCLRGPDTKKSSVGAFTLKFDLQKKKPGIRKERVGEESTWMLSRFYPILEDLIEKLSKGELPKDEYHCMNDPSPSFRGIPGSTSARTSPAHQPAQSMRSRRIGGTWARPRNSDDGYSSDSVLKHASSDLRKLGPRLFIFVIGGATRSELRVAHKLSSKLKREIILGSSSLDDPPQFITKLKMLSTEELSLDDLQI

SEQ ID NO: 5959 - protein, 667 aa, Zea mays
MSMDSDSSSHSGADYRSFRQITRDRLLVEMLRSTRKSSKSSWKVLIMDKLTVKIMSFSCKMADITEEGVSLVEDLYKRRQPLPSMDAIYFMQPTKENVDIFMSDMSGKNSLYKKAYVFFSSPVQRELVAHIKKDSTVLTRISALSEMNLEYFAIDSQGFITDHDKALEELFSEDAEGSHKYNACLNTMATRIATVFASLREFPRVHYRVARTIDASTLTTLRDLVPTKLAASLWNSLVRFKSTIPEFPQTETCELLIVDRSIDQIAPIIHEWTYDAMCHDLLCMDGNKYVQEVPSKNGSANEKKEVLLEDHDPVWLELRHAHIAHVNETLHEKMTSFVSKNKAAQLQQARSGGELSTKQLQKMVQALPQYSDQIDKLTLHVEIAGKLNNIIKEHHLKDVGQLEQDLVFGDAGTKELISFLRTRMDVSREHKLRLLMIYASINPEKFFESEKGAKLMQLAGLSADDMIVVNNMRCLRGADSKKSSVGAFTLKFDLQKKKPGIRKERTGEESTWMLSRFYPILEDLIEKLSKGELPKDEYHCMNDPSPSFRGIPGSTSARTSPAHQPAQSMRSRRIGGTWARPRNSDDGYSSDSVLKHASSDFRKLGQRLFIFVIGGATRSELRVAHKLSGKLKREIILGSSSLDDPPQFITKLKMLSTEELSLDDLQI

SEQ ID NO: 5960 - protein, 672 aa, Brachypodium distachyon
MSTDSDTSSRNGADRRSFREITRDRLLIEMLRSAKNNSRSTWKVLIMDKLTVKIMSFSCKMADITEQGVSLVEDLYKRRQPLPSMDAIYFMQPTKENVRIFMSDMSGKHPLYKKAYVFFSSPVQKELVSQIRKDSSLITRVGALSEMNLEYFAIDSQGFITDHDKAIEELFTENAEGSMKYNSCINMMGTRIATVFASMREFPRVHYRVARTIDASTLTTLRDLVPTKLAASVWNCLARYKSTIPEFPQTETCELLIADRSMDQIAPIIHEWTYDAMCHDLLCMDGNKYVQEVPSKTGSGTEKKEVLLEDHDPIWLELRHLHIADANLRLHEKMTNFISKNKAAQLYKAKFGQQTRTGGELSTKELQKMVQALPQYSDQIDKLSLHVEIADKLSDMIKQQHLKDVGQLEQDLVFGEAGTKELINFFRTRLDTSRENKLRLLMIYAAINPEKIQGDKGAKLMQLAGLSADDMIAVNNMHCLCAHDTKKSSTGGFTMKFDLHKKKRGIRKERVGEESTWLLSRFYPILEELIEKLSKGELPKDEYHCMSDPSSSFRGIPSSMSARASPAHPPAQSMRSRWTGGTWARPRNSDDGYSSDSVLKHASSDMRKLGRRLFIFVVGGATRSELRAAHKLSSKLNREIILGSSSLDDPPQFITKLKMLSTEELTLDDLHI

SEQ ID NO: 5961 - protein, 576 aa, Setaria italica
TTSGWLLLPPPPPFQAFAQPTARSLPNAHPLLSSRDHRLSLASSGSLQSVPPGFSSRLVLRFSVQVMERRRSPRLLLQVFFLLAASSPLGSAGIGGLGVGPESNGASVSPRNSRRLLQIGDGNEDSLFHLPHARTFSHKSRSRKRAPTPAAAPTSAPSPSPFISPPESSPSTSPHASGSMPRQSPSHHHPTAAPPHLDRSRPTTKPDEHDRSVETPVHSSHKHSWTTYGLVAAGIAVFILVSAASVLCFRAKKMGTVRPWATGLSGQLQKAFVTGVPSLQRSELETACEDFSNIIGSTSSCMLYKGTLSSGVEIAVASSLVTSAKDWSKENESQYRKKITSLSKVSHKNFMNLLGYCEEEHPFTRVMVFEYAPNGTLFEHLHIREAEKLDWMARLRISMGIAYCLEHMHQLKTPVVPRNFDSTTIYLTDDFAAKVSDLEFWNDAKGHNSTNDNLTSSSDLESVVRKYGIVLLEILTGRAPHSEVDGPLEHWASRYFDGQMRLEELIDPSMGSFPEDAARALCEVVRSCIDPDPKKRPRMAEVAARMREITALGPDGATPKVSPLWWAELEIMSSET

SEQ ID NO: 5962 - protein, 236 aa, Sorghum bicolor
MQRDARSWSPAAATEAGGRPYAMPSPVQPSSTSPCPARCHMSYLLLSGTKETVKNALSRWGRKVGEATRKAEDLSRNTWQHLRTAPSIAEAAVGRIAQGTKVLAEGGHDRIFRQAFSAPPDEQLRKSYACYLSTAAGPVMGVMYLSTARVAFCSDSPLSYEASGGDRTEWSHYKVAIPLHRLRAASPSANKLKPAEKFIQLVSVDSHEFWFLGFVNYDSAVAHLQEALSGFRNLQA

SEQ ID NO: 5963 - protein, 286 aa, Sorghum bicolor
VEPKQPAAPFRYARGSRIGIGIGIGREVWAGTQETHREGGGTGEHSNQLPMQRDARSWSPAAATEAGGRPYAMPSPVQPSSTSPCPARCHMSYLLLSGTKETVKNALSRWGRKVGEATRKAEDLSRNTWQHLRTAPSIAEAAVGRIAQGTKVLAEGGHDRIFRQAFSAPPDEQLRKSYACYLSTAAGPVMGVMYLSTARVAFCSDSPLSYEASGGDRTEWSHYKVAIPLHRLRAASPSANKLKPAEKFIQLVSVDSHEFWFLGFVNYDSAVAHLQEALSGFRNLQA

SEQ ID NO: 5964 - protein, 216 aa, Brachypodium distachyon
MQAPAGRTWSPMATEANPYAMPAPAQKSTKETVKNALSLWGRKVGEATRKAEDLSRNTWQHLRTAPSITEAAVGRIAQGTKVLAEGGHDKIFRQAFSAPPDEQLRKSYACYLSTSAGPVMGVMYLSTARVAFCSDNPLSYEASGGDRTEWSYYKVAIPLHRLRAAIPSASKLKPAEKFIQLVSVENHEFWLMGFVNYGSAVMHLQEVLSGFHNLQA

SEQ ID NO: 5965 - protein, 255 aa, Hordeum vulgare
AEATIPFRHPRRARGGTFQGFQAPTRGRSAGCSAVDPGMQAPAGRTWSPMATEVNPYAMPAPAQKSTKETVKNALSLWGRKVGEATRKAEDLSRNTWQHLRTAPSITEAAVGRIAQGTKVLAEGGHDRIFRQAFSAPPDEQLRKSYACYLSTSAGPVMGVMYLSTARVAFCSDNPLSYEAGGGGDNTEWSYYKVAIPLHRLRAAIPSASKLKPAEKFIQLVSVENHEFWLMGFVNYSGAVVHLQEALSGFHNLQA

SEQ ID NO: 5966 - protein, 253 aa, Secale cereale
REYIAGSGGHEVEHSEFQAPRRRRRGAGRSAADPAMQAPAERTWSPMATEANPYAMPAPAQKSAKETVKNALSLWGRKVGEAGRKAEDLSRNTWQHLRTAPSMAEAAVGRIAQGTKVLAEGGHDRIFRQAFSAPPDEQLRKSYACYLSTSAGPVMGVMYLSTARVAFCSDAPLSYEAHGHAGDNTEWSYYKVAIPLHRLRAAIPSASKLKPAEKFIQLVSVENHEFWLMGFVNYSSAVVHLQEALSGFHNLQA

SEQ ID NO: 5967 - protein, 216 aa, Triticum aestivum
MQAPAGRTWSPMATEANPYAMPAPAHKSTKETVKNALSLWGRKVGEASRKAEDLSRNTWQHLRTAPSMTEAAVGRIAQGTKVLAEGGHDRIFRQAFSAPPDEQLRKSYACYLSTSAGPVMGVMYLSTARVAFCSDTPLSYEAHAGDNTEWSYYKVAIPLHRLRAAIPSASKVKPAEKFIQLVSVENHEFWLMGFVNYSSAVVHLQEALSGFHNLQA

SEQ ID NO: 5968 - protein, 205 aa, Brachypodium distachyon
MATEANPYAMPAPAQKSTKETVKNALSLWGRKVGEATRKAEDLSRNTWQHLRTAPSITEAAVGRIAQGTKVLAEGGHDKIFRQAFSAPPDEQLRKSYACYLSTSAGPVMGVMYLSTARVAFCSDNPLSYEASGGDRTEWSYYKVAIPLHRLRAAIPSASKLKPAEKFIQLVSVENHEFWLMGFVNYGSAVMHLQEVLSGFHNLQA

SEQ ID NO: 5969 - protein, 235 aa, Setaria italica
MQPAARSWSSPPAATEASPYAMPSPVQPASSNVRRFLHSFAVPRSGTKEAVKNALSRWGRKVGEATRKAEDLSRNTWQHLRTAPSIGEAAVARIAQGTKVLAEGGHDKIFRRAFSAPPDEQLRKSYACYLSTAAGPVMGILYLSTARVAFCSDSPLSYDAGGGDRTEWSYYKVAIPLHRLRAASASASELKPAEKFIQLVSADKHEFWFMGFVNYDGAVAHLQEALSGFHNLQAL

SEQ ID NO: 5970 - protein, 100 aa, Secale cereale
EKGTLQAMRGWVVDHKLRAVGTLWLTGIAGSIAYNWSRPGMKTSVKLIHARLHAQALTLAALGCSALVEYYDHQSGSGSKVHDYAKQFLPSDRNAKKDSV

SEQ ID NO: 5971 - protein, 442 aa, Saccharum officinarum
MHPQQRMKQAAAAAQQQQLMQQALLLQQQQAQPPLFPGQHHPHPGLLAAPQMEPIVSGNLPPGFDSSTCRSVYVGNISLQVTDAVLQEVFQSIGPVEGCKLIRKEKSSFGFIDYYDRRYAALAILSLNGRPLYGQPIKVNWAYTSTQREDTSGHFNIFVGDLCPEVTDATLFAFFSGYSTCSDARVMWDQKTGRSRGFGFVSFRNQQDAQSAINDLNGKWLGNRQIRCNWATKGASAGEEKQIVDSKADLTNGTSESGKENLNEDGPESNPQFTTVYVGNLPHEATNNDVHLFFHSLGAGSIEEVRVTRDKGFGFVRYSTHEEAALAIQMGNGQLIGGRQIKCSWGSKPTPPGTASSPLPPPAPAPFSTGVSATDFMAYQRLALSKMATNPALMGQHALKQVAALGMGGGASQSVYDGGFQGINTATATTSAQQQQQQLMYY

SEQ ID NO: 5972 - protein, 444 aa, Panicum virgatum
MHQQRMKQAAAAAAAQQQQLMQQALLLQQQQQQQQAQPPLFPGHHPHPGLLAAPQIEPIVSGNLPPGFDSSTCRSVYVGNIHLQVTDMLLQEVFQSIGPVEGCKLIRKEKSSFGFIDYYDRRSAALAILSLNGKPLYGQPIKVNWAYTSTQREDTSGHFNIFVGDLCPEITDAALFAFFSGYSTCSDARVMWDQKTGRSRGFGFVSFRNQQDAQNAINDLNGKWLGNRQIRCNWATKGANAGDEKQSVDTKVDQTNGSSEAGKENSNEDGPENNPLFTTVYVGGLPHEATNNDVHLFFHSLGAGSIEEVRVTRDKGFGFVRYSTHEEAALAIQMGNGQLIGGRPIRCSWGNKPTPPGTASSPLPPPAPSPFPTGASATDLLAYQRLALSKIAANPSLMGQHALKQAALGMGAGASQAIYDGGYPGINAAAAAQQQQQQQQLMYF

SEQ ID NO: 5973 - protein, 444 aa, Cenchrus ciliaris
  misc_feature (277)..(277): Xaa can be any naturally occurring amino acid
  misc_feature (287)..(287): Xaa can be any naturally occurring amino acid
  misc_feature (295)..(295): Xaa can be any naturally occurring amino acid
  misc_feature (360)..(360): Xaa can be any naturally occurring amino acid
MHQQQRMKQAAAAAAQQQQQLMQQALLLQQQQQQTQPPVFPGHHHHHPGLLTAPQIEPIVSGNLPPGFDSSTCRSVYVGNIHLQVTDAVLQEVFQSIGPVEGCKLIRKEKSAFGFVDYYDRQSAALAIMSLNGRLLYGQPIKVNWAYTSTQREDTSGHFNIFVGDLCPEITDATLFAFFAVYSTCSDARVMWDQKTGRSRGFGFVSFRSQQDAQNAINDLNGKWLGNRQIRCNWATKGANAGEEKQSVDTKVDQTNGSAEAGQENPNEVVPENNPLXTTVYVGGLPXEASNNDVXLFFHSLGAGLIEEVRVTRDKGFGFVRYSTHEEAALAIQMGNGQLFGGRPIRCSWGNKPTPPGTAXSPLPPPAPAPFPAGVSATDFLAYQRLALSKIATNPALMGQHALKQAALGMDAGASQAVYDGGFQGISTAAAAAQQQHQQQLMYF

SEQ ID NO: 5974 - protein, 423 aa, Panicum virgatum
MQQALLLQQQQQAQPPLFPGHHPHPGLLDAPQIEPIVSGNLPPGFDSSTCRSVYVGNIHLQVTDTLLQEVFQSIGPVEGCKLIRKEKSSFGFIDYYDRRSAALAILSLNGKQLYGQPIKVNWAYTSTQREDTSGHFNIFVGDLCPEITDAALFAFFSGYSTCSDARVMWDQKTGRSRGFGFVSFRNQQDAQNAINDLNGKWLGNRQIRCNWATKGANAGEEKQSVDTKVDQTNGSSEAGKDNLNEDGPENNPLFTTVYVGGLPHEATNNDVHLFFHSLGVGSIEEVRVTRDKGFGFVRYSTHEEAALAIQMGNGQLIGGRPIRCSWGNKPTPPGTASSPLPPPAPSAFPTDVSATDFLAYQRLALSKIAANPALMGQHALKQAALGMDAGASQAIYDGGFPGVNAAATAAAQQQQQQQQLMYF

SEQ ID NO: 5975 - protein, 315 aa, Pennisetum glaucum
MSLNGRQLYGQPIKVNWAYTSTQREDTSGHFNIFVGDLCPEITDATLFAFFARYSTCSDARVMWDQKTGRSRGFGFVSFRNQQDAQNAINDLNGKWLGNRQIRCNWATKGANAGEEKQSVDTKVDQTNGSSEAGQENPNEVGPENNPLFTTVYVGGLPHEASNNDLHLFFHSLGAGLIEEVRVTRDKGFGFVRYSTHEEAALAIQMGNGQLFGGRSIRCSWGNKPTPPGTASSPLPPPAPAPFPAGVSATDFLAYQRLALSKVAANSALMGQHALKQAALGMDPGASQAIYDGGFQGINAAAAAQQQQQQQLMYF

SEQ ID NO: 5976 - protein, 451 aa, Brachypodium distachyon
MSMQQRMKQAAAVAAQQQQMMQQALLMQQQQQAATAAQQQPPMFPQHHPHPGLLAAPQIEPIVSGNLPPGFDSSTCRSVYVGNIHLQVTDSLLHEVFQSIGPVEGCKLIRKEKSSFGFVDYYDRRSAALAIVSLNGRQLFGQPIKVNWAYASTQREDTSGHFNIFVGDLCPEVTDAALFAFFSAYSTCSDARVMWDQKTGRSRGFGFVSFRNQQDAQTAINELNGKWLGNRQIRCNWATKGANAGEEKQNTDSKGMVELINGSSEAGKENANEDGPENNPQYTTVYVGNLPHDINSNDVHRFFHLLGAGSIEEVRVTRDKGFGFVRYSTHEEAALAIQTGNGQLVGGRQIKCSWGSKPTPPGTASAPLPPPALAVAPYTPGVSAADLFSYERSLALSKMAGNPALMGQHAALRQAAMGMGAGASQAIYDGGFQGVNPQQQQQQQQQQLMYY

SEQ ID NO: 5977 - protein, 424 aa, Setaria italica
MQQALLLQQQQQQPQPPLFPGATPAPPASSPRRKIEPIVSGNLPPGFDSSTCRSVYVGNIHLQVTDAVLQEVFQSIGPVEGCKLIRKEKSSFGFIDYYDRRSAALAIMSLNGRQLYGQPIKVNWAYTSTQREDTSGHFNIFVGDLCPEITDAALFAFFSGYSTCSDARVMWDQKTGRSRGFGFVSFRNQQDAQNAINDLNGKWLGNRQIRCNWATKGANAGEEKQSVDTKVDQTNGSSEAGQENPNEVGPENNPLFTTVYVGGLPHEASNNDVHLFFHSLGAGLIEEVRVTRDKGFGFVRYSTHEEAALAIQMGNGQLIGGRPIRCSWGNKPTPPGTASSPLPPPAPSPFLGGVSATDFLAYQRLALSKIAANPALMGQHALKQATLGMDTGASQAIYDGGFQGINAATAAAQQQQQQQQLMYF

SEQ ID NO: 5978 - protein, 424 aa, Avena sativa
MQHQQQQQQAQQQQAAAGPPMFPTHHPHPGLLAAPQIEPIVSGNLPPGFDSSTCRSVYVGNIHLQVTDALLHEVFQSIGPVEGCKLIRKEKSSFGFVDYYDRRYAALAIVSLNGRQLFGQPIKVNWAYTSTQREDTSGHFNIFVGDLCPEVTDAALFAFFSAYSTCSDARVMWDQQTGRSRGFGFVSFRNQQDAQTAINELNGKWLGNRQIRCNWATKGANAGEEKQSTDSKGMVELINGTSEAGKENANGDGPENNPQYTTVYVGNLPHDINSNDVHRFFHLLGAGSIEEVRVTRDKGFGFVRYSTHEEAALAIQTGNGQVIGGRQIKCSWGSKPTPPGTASAPLPPPALAPYTPGMSAADLFSYERSLALSKMAANPGLMGQHAALRQAAMGMGAGASQAIYDGGFQSVNPQQQQQQQVMYY

SEQ ID NO: 5979 - protein, 413 aa, Setaria italica
MHQQQPPLFPGQHPHPGLLAAPQIEPIVSGNLPPGFDSSTCRSVYVGNIHLQVTDAVLQEVFQSIGPVEGCKLIRKEKSSFGFIDYYDRRSAALAIMSLNGRQLYGQPIKVNWAYTSTQREDTSGHFNIFVGDLCPEITDAALFAFFSGYSTCSDARVMWDQKTGRSRGFGFVSFRNQQDAQNAINDLNGKWLGNRQIRCNWATKGANAGEEKQSVDTKVDQTNGSSEAGQENPNEVGPENNPLFTTVYVGGLPHEASNNDVHLFFHSLGAGLIEEVRVTRDKGFGFVRYSTHEEAALAIQMGNGQLIGGRPIRCSWGNKPTPPGTASSPLPPPAPSPFLAGVSATDFLAYQRLALSKIAANPALMGQHALKQATLGMDTGASQAIYDGGFQGINAATAAAQQQQQQQQLMYF

SEQ ID NO: 5980 - protein, 378 aa, Setaria italica
MTSCFNGGAGWPEPVVRVQTVSDTCGDTIPDRYVKPQSDRPSPPASGGVAGGGPNIPVVDLSMPDSDATSRAVAAACREWGFFQAVNHGVRPELLRGARAAWRGFFRQPAEVRERYANSPATYEGYGSRLGTAKGGPLDWGDYYFLHLLPPSLKSHEKWPSLPASLRETTEEYGEEVVQLCRRVMRLLSSGLGLEAGRLQEAFGGAGGEGACMRVNFYPRCPQPELTLGVAAHSDPGGMTMLLVDDHVRGLQVRSPDGQWITVEPVPDAFIVNVGDQIQVLSNAAYKSVEHRVTVSAAEERLSMAFFYNPRSDLPIAPMPELVAPGRPALYPEMTFDEYRVFIRQRGLAGKAQLESLKASNKAAAAPVTADGSPSSSS

SEQ ID NO: 5981 - protein, 427 aa, Zea mays
MAISCFNGGAGWPEPVVRVQAVSDTCGDTIPERYVKPLSERPRLSPASDGSGPNIPVVDLSMLDVDATSSAVAAACREWGFFQAVNHGVRPELLRGARAAWRGFFRQPAEVRERYANSPATYEGYGSRLGTAKGGPLDWGDYYFLHLLPASLKSHEKWPSLPSSLRGATEEYGEEVLQLCRRVMRLLSSGLGLEAGRLQAAFGGEGGEGACLRVNFYPQCPQPELTLGVAGHSDPGGMTMLLVDDHVKGLQVRSPDGQWIVVEPVPDAFIVNVGDQIQVLSNAAYKSVEHRVTVSAAEDRLSMAFFYNPRSDLPIAPMAELVGPDRPALYPEMTFDEYRVFIRQRGLAGKAQLESLQVKKKFDGDFTSKEMFVSGKSRSDYVLLPLHNEGQWSRYIMVVQGSNMTLIEGLVENEYRRSFHGLGVDEQ

SEQ ID NO: 5982 - protein, 2184 aa, Zea mays
MANLGGGAEAHARFKQYEYRANSSLVLTTDSRPRDTHEPTGEPETLWGRIDPRSFGDRAVQNRPPELEEKLSKSRTKKSKRDAAAALDSADLPRRDAKRRRRAASAQEVSVLSLTDDAVYKPQTKETRAAYEALLSLIQQQLGGQPLDVLAGAADEVLATLKNDKVKNPDKKKDIEQLLNPISSQLFDQLVSIGKLITDFHDAAAGDASGAPSADAVDTTLDDDVGVAVEFEEDEDEESDFDQVQDELDEDEEDDMAELNGPGGMQMGGELDDDDMQNANQGLTVNVQDIDAYWLQRKISQAYGDGDIDAQQSQKLAEDILKIIAEGDDRDVENRLVMLLDYEKFDLIKLLLRNRLKIVWCTRLARAEDQEQRKNIEEEMASDPSLAPILEQLHATRASAKERQKNLEKSIRDEAKRLLNNDAAAAGADGARDHRAAEWDMESGWLKGQRQLLDLESLSFHQGGLFMANKKCELPTGSFRTPHKGYEEVHVPALKAKPYETGEKIVKISDMPEWARSAFDGMTQLNRVQSRVYDTALFKPDNILLCAPTGAGKTNVAVLTILQQIGLHMQDGEFDNTKYKIVYVAPMKALVAEVVGNLSKRLAGYNVTVRELSGDQNLTKQQIDETQIIVTTPEKWDIVTRKSGDRTYTQMVKLLIIDEIHLLHDNRGPVLESIVARTVRQIETTKENIRLVGLSATLPNYEDVALFLRVRKESLFYFDNSYRPCPLAQQYIGITVRKPLQRMQLMNEICYEKVMAAAGKHQVLIFVHSRKETAKTAKAIRDTALANDTVSRFLKNESASQEILGTHAELVKNNDLKDLLPYGFAIHHAGMARVDRELVEELFADKHIQVLVSTATLAWGVNLPAHTVIIKGTQIYNPEKGAWTELSPLDVMQMLGRAGRPQYDTHGEGIILTGHSELQFYLSLMNQQLPIESQFISKLADQLNAEIVLGTIQNAREACSWLGYTYLYIRMLRNPTLYGLPADILESDKTLDERRADLIHSAANLLDRNNLIKYDRKTGYFQVTDLGRIASYYYISHGTISTYNEYLKPTMGDIELCRLFSLSEEFKYVGVRLDEKMELAKLLDRVPIPVKESLEEPSAKINVLLQAYISRLKLEGLSLSSDMVYIRQSAGRLLRALFEIVLKRGWAQLAEKALNLCKMVDKQMWSVQTPLRQFTGIPKEILMKLEKKELAWERYYDLSSQEIGELIRYPKMGRPLHKCIHQLPKLNLSAHVQPITRTVLGFELTITPDFQWDDKVHGYVEPFWVIVEDNDGEYILHHEYFMLKKQYVDEDHTLNFTVPIYEPLPPQYFIRVVSDKWLGSQTILPVCFRHLILPEKYAPPTELLDLQPLPVSALRNARYEGLYSAFKHFNPIQTQVFTVLYNSDDSVLVAAPTGSGKTICAEFAILRNHQKALSGESNMRVVYIAPIEALAKERYRDWERKFGEFAKVVELTGETAADLKLLDKGEIIISTPEKWDALSRRWKQRKHIQQVSLFIVDELHLLGSDKGHVLEVIVSRMRRISSHIGSNIRIVALSASLANAKDLGEWIGATSHGLFNFPPAVRPVPLEIHIQGVDIANFEARMQAMTKPTYTAITQHAKNNKPALVYVPTRKHARLTALDLCAYSSVEGAGTPFLLGSGDEMDTFTRGVEEETLKNTLKCGVGYLHEGLSELDQELVTQLFLGGRIQVCVASSTMCWGRPLPAHLVVVMGTQYYDGRENAHTDYPITDLLQMMGHASRPLQDNSGKCVILCHAPRKEYYKKFLFEAFPVESNLHHFLHDHMNAEVVVGVVENKQDAVDYLTWTFMYRRLAKNPNFYNLQGVSHRHLSDHLSELVETILNDLESSKCVAIEEDMYLKPLNLGLIASYYYISYTTIERFSSMLTQKTKVKGLLEILASASEYAELPGRPGEEEFIERLVRHQRFSIEKPKYGDPHVKANALLQAHFSRHTVVGNLAADQREILLSAHRLLQAMVDVISSNGWLSLALSTMELSQMVTQGMWDRDSVLLQVPHFTKDLARRCQENEGKPIESIFDLAEMAVDEMRDLLQLSNSQLQDIIEFIKRFPNVDMTYEVREGDDISAGDNVTVQVTLERDMTNVSSEVGPVHAPRFPKPKEEGWWLVIGDSSTNQLLAIKRVALQKRARVKLEFSAPAEAGRKDYMIYLMSDSYLGCDQEYEFTVDVKDAGGD

SEQ ID NO: 5983 - protein, 2178 aa, Setaria italica
MANLGGGAEAHARFKQYEYRANSSLVLTTDSRPRDTHEPTGEPETLYGRIDPRSFGDRAVQNRPPELEEKLTKARTKKTKRDAADPDIPRRDAKRRRRAASTQDVSVLSLTDDVVYKPQTKETRAAYEALLSVIQQQLGGQPLDVLAGAADEVLATLKNDKIKNPDKKKDIEQLLNPISNQLFDQLVSIGKLITDFHDAAAGDAAGGPSGDAMDTTLDDDVGVAVEFEESDEDEESDFDQVQDDLDEDDEDEATELNGPGGMQMGGELDDDDMQNANQGLAINVQDIDAYWLQRKISQAYGDGNIDAQQSQKLAEEILKIIAEGDDRDVENRLVMLLDYDKFDLIKLLLRNRLKIVWCTRLARAEDQEQRTKIEEEMASDPSLAPILEQLHATRASAKERQKNLEKSIRDEAKRLLNNDGAGADGPRDRRAAERDMESGWLKGQRQLLDLDSLAFHQGGLFMANKKCELPAGSFRTPHKGYEEVHVPALKAKPYETGEKIVKISDLPEWAQPAFEGMSALNRVQSRVYDTALFKPDNILLCAPTGAGKTNVAVLTILQQIGLHMKDGEFDNTKYKIVYVAPMKALVAEVVGNLSKRLAPFNVTVRELSGDQNLTKQQIDETQIIVTTPEKWDIVTRKSGDRTYTQMVKLLIIDEIHLLHDNRGPVLESIVARTVRQIETTKEHIRLVGLSATLPNYEDVALFLRVPKKSIFHFDNSYRPCPLAQQYIGITVRKPLQRFQLMNEICYEKVMAAAGKHQVLIFVHSRKETAKTAKAIRDTALANDTVSRFLKNESASQEILGTHAELVKNNDLKDLLPYGFAIHHAGMARVDRELVEELFADKHIQVLVSTATLAWGVNLPAHTVIIKGTQIYNPEKGAWTELSPLDVMQMLGRAGRPQYDTHGEGIILTGHSELQFYLSLMNQQLPIESQFVSQLADQLNAEIVLGTIQNAREACSWLGYTYLYIRMLRNPALYGLPADIFESDKTLDGRRADLIHSAANLLDRNNLIKYDRKTGYFQVTDLGRIASYYYISHGTISTYNEYLKPTMGDIELCRLFSLSEEFKYVGVRQDEKMELAKLLDRVPIPVKESLEEPSAKINVLLQAYISRLKLEGLSLSSDMVYIRQSAGRLLRALFEIVLKRGWAQLAEKALNLCKMVDKQMWSVQTPLRQFPGIPKEILMKLEKKELAWERYYDLSSQEIGELIRYPKMGRQLHKCIHQLPKLNLSAHVQPFTRTVLGFELTITPDFQWDDKIHGYVEPFWVIVEDNDGEYILHHEYFLLKKQYVDEDHTLNFTVPIYEPLPPQYFIRVVSDKWLGSQTILPVCFRHLILPEKYAPPTELLDLQPLPVSALRNARYEGLYSSFKHFNPIQTQVFTVLYNSDDSVLVAAPTGSGKTICAEFAILRNHQRAVSGESNMRVVYIAPIEALAKERYRDWERKFGEFAKVVELTGETAADLKLLDKGEIIISTPEKWDALSRRWKQRKHIQQVSLFIVDELHLLGSDKGHVLEVIVSRMRRISSHIGSNIRIVALSASLANAKDLGEWIGATSHGLFNFPPAVRPVPLEIHIQGVDIANFEARMQAMTKPTYTAITQHAKSGKPALVYVPTRKHARLTALDLCAYSSVEGGGTPFLLGSEEEMDTFTSGVEEETLKNTLKCGVGYLHEGLSELDQELVTQLFLGGRIQVCVASSTMCWGRPLPAHLVVVMGTQYYDGRENAHTDYPITDLLQMMGHASRPLQDNSGKCVILCHAPRKEYYKKFLFEAFPVESNLHHFLHDHMNAEVVVGVVENKQDAVDYLTWTFMYRRLTKNPNYYNLQGVSHRHLSDHLSELIETILNDLESSKCVAIEEDMYLKPLNLGLIASYYYISYTTIERFSSMLTQKTKMKGLLEILASASEYAELPGRPGEEDFIERLVRHQRFSIEKPKYGDPHVKANALLQAHFSRHNVVGNLAADQREILLSAHRLLQAMVDVISSNGWLSLALNTMELSQMVTQGMWDRDSVLLQVPHFTKDLARRCQENEGKPIESIFDLAEMGIDEMRDLLQLSNSQLQDIIEFFKRFPNVDMAYEVREGDDISAGDNVTVQVTLERDMTNLPSEVGPVHAPRFPKPKEEGWWLVIGDSSTNQLLAIKRVALQKRARVKLEFSAPAEAGRKDYMIYLMSDSYLGCDQEYEFTVDVKDAGD

SEQ ID NO: 5984 - protein, 2173 aa, Sorghum bicolor
MSNLGGAEAHARFKQYDYGANSSLVLTTDSRPRDTHEPTGEPETLRGRIDPRSFGDRAVHNKPPELDEKLSKARSKKSKRRDDAPDLPRRDAKRRRRAASVHEVSVLSLTEDAVYKPQTKETRAAYEALLSLIQHQLGGQPLDVLAGAADEVLATLKNDKVKNPDKKKVIEQLLNPISSQLFDQLVSIGKLITDFHDAGAPSADAMDTTLDDDVGVAVEFEEDEAEESDFDQVQDDLDEDDEDDAAELNGPGGMQMGSELDDDNDMHNANQGLAVNVQDIDAYWLQRKISQAYGDGVIDAQQGQKLAEDILKIIAEGDDRDIENCLLMLLDFDKFDLIKLLLRNRLKIVWCTRLARAEDQEQRKKIEEEMASDPSLALILEQLHATRASAKERQKNLEKSIRDEAKRLLNNDAAAGADGARDRRAAERDMESGMLKGQRKLLDLKSLSFQQGGLFMANKKCELPTGSFRTSHKGYEEVHVPALKAMPYETGEKIVKICDMPEFARAAFEGMTQLNRVQSRVYDTALLKPDNILLCAPTGAGKTNVAVLTILQQIGMHMQDGEFDNTKYKIVYVAPMKALVAEVVGNLSKRLAGYNVTVKELSGDQNLTKQQIDETQVIVTTPEKWDIVTRKSGDRTYTQMVKLLIIDEIHLLHDNRGPVLESIVARTVRQIETTKEHIRLVGLSATLPNYEDVALFLRVPKESLFYFDNSYRPCPLAQQYIGITVRKPVQRMPLMNEICYEKVMAAAGKHQVLIFVHSRKETAITAKAIRDMALANDTVSRFLKNDSVSQEILGTNAELVKSNDLKDLLPYGFAIHHAGMARVDRELVEALYADKHIQVLVSTATLAWGVNLPAHTVIIKGTQIYNPEEGDWTELSPLDVMQMLGRAGRPQYDTHGEGIILTSHSELRFYLSLMNQQLPIESQFISKLADQLNAEIVLGTIQNAREACSWLGYTYLYIRMLRNPTLYGLPADILESDKTLDEMRADLVHSAANLLDKNNLIKYDRKTGYFQVTDLGRIASYYYISHGTISTYNEYLKPTMGDIELCRLFSLSEEFKYVGVRLDEKMELAKLLDRVPIPVKESLDEPSAKINVLLQAYISRLKLEGHSLSSDMVYIQQSAGRLLRALFEIVLKRGWAQLAEKALNLCRMVDKQMWSVQTPLRQFTGIPKAILMKLEKKELAWERYYDLSSQEIGELIRYPKMGRQLHKCIHQLPKLNLSAHVQPITRTVLGFELTITPDFQWDDKVHGYVEPFWVIVEDNDGEYILHTEYFMLKKQYVDEDHTLNFTVPTYEPLPPQYFIRVVSDKWLGSLTILPVCFRHLILPEKYAPPTELLDLQPLPVSALRNARYEGLYSAFKHFNPIQTQVFTVLYNTDDSVLVAAPTGSGKTICAEFAILRNHQRAVSGESNMRVVYIAPIEALTKERYRDWERKFGEFAKVVELTGETAADLKLLDKGEIIISTPEKWDALSRRWKQRKHIQQVSLFIVDELHLLGSDKGHVLEVIVSRMRRISSHTGSNIRIVALSASLANAKDLGEWIGATSHGLFNFPPAVRPVPLEIYIQGVDIANFEARMQAMTKPTYTAITQHAKNSKPALVYVPTRKHARLTALDLCAYSSVDGGGTLFLLGSEDEMDTFTRGVEEETLKNTLKCGVGYVHEGLSELDQELVTQLFLAGRIQVCVASSTMCWGRPLPAHLVVVMGTQYYDGRENAHTDYPITDLLQMMGHASRPLKDNSGKCVILCHAPRKEYYKKFLFEAFPVESNLHHFLHDHMNAEVVVGVVENKQDAVDYLTWTFMYRRLTKNPNFYNLQGVTHRHLSDHLSELVEAFLNDLESSKCVAIEEDMYLKPLNLGLIASYYYVSYTTIERFSSMLTQKTKMKGLLEILASASEYAELLGRPGEEEFIERLVRHQRFSIDKPKYGDPHVKANALLQAHFSRHTVVGNLAADQREILFSAHRLLQAMVDVISSNGWLSVALSAMESSQMVTQGMWDRDSVLLQVPHFTKDMARRCQENEAKPIESIFDLAEVGVDEMRDLLQLSNSQLQDIIEFFKRFPNVDMTYVVRAGDDISTGDNVTVQVTLERDMTNLPSEVGSVHAPRFPKPKEEGWWLVIGDSSTNQLLAIKRVALQKRARVKLEFSAPPEAGRKNYMIYLMSDSYLGCDQEYEFTVDVKDAGGD

SEQ ID NO: 5985 - protein, 2177 aa, Oryza sativa
MANLGGGAEAHARFKQYEYRANSSLVLTTDSRPRDTHEPTGEPETLWGRIDPRSFGDRAVQAKPPELEEKLTKSRKKKAAAADPDDLHRRDAKRRRRAAAAQREVSVLSLTDDVVYKPQTKETRAAYEALLSVIQQQFGGQPLDVLGGAADEVLAVLKNDKIKSPDKKKEIEKLLNPISNQMFDQIVSIGKLITDFHDASAGDSAAAPSGDGMDTALDDDIGVAVEFEENEDDEESDFDQVQDDLDEDEDDDLPESNAPGAMQMGGELDDDDMQNSNEGLTINVQDIDAYWLQRKVSQAYEDIDPQHSQKLAEEILKIIAEGDDRDVENRLVMLLDYEKFDLIKLLLRNRLKIVWCTRLARAEDQEQRKKIEEDMMGNPTLTPILEQLHATRASAKERQKNLEKSIRDEAKRLTKSENTGIDGARDRRAVDRDMESGWLKGQRQLLDLDSLSFHQGGLLMANKKCELPPGSFRTPHKGYEEVHVPALKAKPYETGEKIVKISDMPEWAQPAFAKMTQLNRVQSKVYETALFKPDNILLCAPTGAGKTNVAVLTILQQIGLHMKDGVFDNTKYKIVYVAPMKALVAEVVGNLSARLSAYGITVRELSGDQNLTKQQIDETQIIVTTPEKWDIVTRKSGDRTYTQMVKLLIIDEIHLLHDNRGPVLESIVSRTVRQIETTKEHIRLVGLSATLPNYEDVAVFLRVRSDGLFHFDNSYRPCPLAQQYIGITVRKPLQRFQLMNEICYEKVMASAGKHQVLIFVHSRKETAKTARAIRDTALANDTLNRFLKDDSASQEILGSQAELVKSSDLKDLLPYGFAIHHAGLARVDRELVEELFADKHIQVLVSTATLAWGVNLPAHTVIIKGTQIYNPEKGAWTELSPLDVMQMLGRAGRPQYDTHGEGIILTGHSELQYYLSLMNQQLPIESQFISRLADQLNAEIVLGTIQNAREACSWLGYTYLYIRMLRNPTLYGLPADIMETDKTLDERRADLVHSAANLLDRNNLIKYDRKTGYFQVTDLGRIASYYYISHGTISTYNEYLKPTMGDIELCRLFSLSEEFKYVSVRQDEKMELAKLLDRVPIPVKESLEEPSAKINVLLQAYISRLKLEGLSLSSDMVYIRQSAGRLLRALFEIVLKRGWAQLAEKALNLCKMIDKQMWNVQTPLRQFPGIPKEILMKLEKKELAWERYYDLSSQEIGELIRFPKMGRQLHKCIHQLPKLNLSAHVQPITRTVLGFELTITPDFQWDDKVHGYVEPFWVIVEDNDGENILHHEYFMVKKQYVDEDHTLNFTVPIYEPLPPQYFIRVVSDKWLGSQTILPVCFRHLILPEKYAPPTELLDLQPLPVTALRNARYEGLYSAFKHFNPIQTQVFTVLYNTDDSVLVAAPTGSGKTICAEFAILRNHQKAVSGESNMRVVYIAPIEALAKERYRDWEQKFGEFARVVELTGETAADLKLLDKGEIIISTPEKWDALSRRWKQRKQVQQVSLFIVDELHLIGSEKGHVLEVIVSRMRRIASHIGSNIRIVALSASLANAKDLGEWIGATSHGLFNFPPAVRPVPLEIHIQGVDIANFEARMQAMTKPTYTAITQHAKNGKPALVFVPTRKHARLTALDLCAYSSAEGGGTPFLLGSEDEMDAFTGGISDETLKYTLKCGVGYLHEGLSDLEQEVVTQLFLGGRIQVCVASSTVCWGRSLPAHLVVVMGTQYYDGRENAHTDYPITDLLQMMGHASRPLQDNSGKCVILCHAPRKEYYKKFLFEAFPVESHLHHFLHDHMNAEVVVGVIENKQDAVDYLTWTFMYRRLTKNPNYYNLQGVSHRHLSDHLSELVETVLNDLESSKCVAIEEDMYLKPLNLGLIASYYYISYTTIERFSSMLTQKTKMKGLLEILASASEYAELPSRPGEEDFIEKLVRHQRFSIEKPKYGDPHVKANALLQAHFSRHTILGNLAADQREILLSAHRLLQAMVDVISSNGWLTLALNAMELSQMVTQGMWDRDSVLLQLPHFTKELARRCQENEGRPIESIFDLAEMSIDEMRDLLQQSNPQLQDIIEFFKRFPNVDMAYEVREGDDIRAGDNVTVQVTLERDMTNLPSEVGPVHAPRYPKPKEEGWWLVIGDSSTNQLLAIKRVALQKRARVKLEFTAASEAGRKEYMIYLMSDSYLGCDQEYEFTVDVMDAGGD

SEQ ID NO: 5986 - protein, 2176 aa, Hordeum vulgare
MANLGGGAEAHARFKQYEYRANSSLVLTTDSRPRDTHEPTGEPETLWGRIDKRSFGDRAVQAKPPELEDRLTKSRKKKERDAASADADADQPRKRRRRSAAAQREESVLSLADDVVYKPQTKETRAAYEAMLSVIQQQFGGQPLDVLGGAADEVLAVLKNDKIKNPDKKKEIEKLLNPISSAMFDQFVSIGKLITDFHDASDPAAVPSGDGGDATMDDDIGVAVEFEEDEDDEESDFDQVQDDLDDDDDDVAELNRPGGMQMGGELDDDDMQNSNEGLNINVQDIDAYWLQRKITQAYEDIDPQQSQKLAEEILKIIAVGDDRDVENRLVMELDYEKFDLIKLVLRNRFKIVWCTRLARAEDQEERKKIEEEMMDDPSLAPILEQLHATRASAKERQKNLEKSIRDEAKRLLNNDSAGTDGPRERRAVERDTESGWLKGQRQLLDLDSLSFHQGGLLMANKKCELPEGSFRTPHKGYEEVHVPALKPRPYGTGEKIVKISDIPGWAQPAFAGMQQLNRVQSKVYDTALFKPDNILLCAPTGAGKTNVAVLTILHQIGLHMKDGEFDNSKYKIVYVAPMKALVAEVVGNLSARLKDFNVNVRELSGDQNLTKQQIDDTQIIVTTPEKWDIVTRKSGDRTYTQMVKLLIIDEIHLLHDNRGPVLESIVSRTVRQIETTKEHIRLVGLSATLPNYEDVAVFLRVRSEGLFHFDNSYRPCPLAQQYIGITVRKPLQRFQLMNEICYEKVMASAGKHQVLIFVHSRKETSKTARAIRDTALANDTLTRFLKDESASQEILGSHTDIVKSSDLKDLLPYGFAIHHAGMARVDRELVEELFADKHIQVLVSTATLAWGVNLPAHTVIIKGTQIYNPEKGAWTELSPLDVMQMLGRAGRPQYDTHGEGIILTGHSELQYYLSLMNQQLPIESQFISKLADQLNAEIVLGTIQNAREACSWLGYTYLYIRMLRNPTLYGLPADIMETDKTLDERRADLVHSAANLLDRNNLIKYDRKTGYFQVTDLGRIASYYYISHGTISTYNEYLKPTMGDIELCRLFSLSEEFKYVSVRQDEKMELAKLLDRVPIPIKESLDEPSAKINVLLQAYISRLKLEGLSLGSDMVYIRQSAGRLLRALFEIVLKRGWAQLAEKALNLCKMIDKQMWSVQTPLRQFPGIPKEILMKLEKKELAWERYYDLSSQEIGELIRFQKMGKQLHRCIHQLPKLNLSAHVQPITRTVLGFELTITPDFLWDDKVHGYVEPFWVIVEDNDGEYILHHEYFMLKKQYVDEDHTLHFTVPIYEPLPPQYFIRVVSDKWLGSQTILPVCFRHLILPEKYAPPTELLDLQPLPVTALRNARYEGLYSAFKHFNPIQTQVFTVLYNSDDSVLVAAPTGSGKTICAEFAILRNHQKAVSGETNMRVVYIAPIEALAKERYRDWSKKFGEFARVVELTGETAADLKLLDKGEIIISTPEKWDALSRRWKQRKPVQQVSLFIVDELHLIGSEKGHVLEIVVSRMRRISSHIGTNIRIVALSASLGNAKDLGEWIGATAHGLFNFPPAVRPVPLEIHIQGVDIANFEARMQAMAKPTYTAITQHAKSGKPALVFVPTRKHARLTALDLCAYSSAEGAGTPFLLGSQDEMDTFIGGVNEETLKNTLRCGVGYLHEGLSDLDQELVTQLFLGGRIQVCVASSTMCWGRSLPAHLVVVMGTQYYDGRESAHTDYPITDLLQMMGHASRPLQDNSGKCVILCHAPRKEYYKKFLFEAFPVESHLHHFLHDHMNAEVVVGVVENKQDAVDYLTWTFMYRRLNKNPNYYNLQGVSHRHLSDHLSELIETVLNDLESSKCVAVEEDMYLKPLNLGLIAAYYYISYTTIERFSSMLTQKTKMKGLLEILASASEYAELPSRPGEEEYIERLVRHQRFSIDKPKYGDPHVKANALLQSHFARHTVVGNLAADQREILLSAHRLLLAMVDVISSSGWLTLALNAMELSQMVTQGMWDRDSVLLQLPHFTRDLARRCQENEGKPVESIFDLAEMSIDEMRDLLQLSNSELQDIVEFFKRFPNVDMSYEVREGDDIRAGDNVTLQVTLERDMTNLPNSEVGPVHAPRFPKTKEEGWWLVVGDSSTKQLLAIKRVTLQKRARVKLEFTAATETGRKDYMIYLMSDSYLGCDQEYEFTVDIKEAGGD

SEQ ID NO: 5987 - protein, 2179 aa, Brachypodium distachyon
MANLGGGAEAHARFKQYEYRANSSLVLTTDSRPRDTHEPTGEPETLWGRIDKKNFGDRAVQAKPPELEERLTKSRKKKERDAATAGDRDAADNLPRKRRRRAAAQREQESVLSLADDVVYRPQTKETRAAYEAMLSVIQQQFGGQPLDVLGGAADEVLTVLKNDKIKNPDKKKEIEKLLNPISNQMFDQFVSIGKLITDFHDASDPAAAPSADGLDATMDDDIGVAVEFEEDDDDEESDFDQVQDELDEEDDDVAELNRPGGMQMGGELDDDDLQNSNEGLTINVQDIDAYWLQRKITQAYEDIDPQQSQKLAEEILKIIAEGDDRDVENRLVMELDYEKFDLIKLVLRNRFKIVWCTRLARAEDQEERKKIEEEMMDNPTLAPILEQLHATRASAKERQKNLEKSIRDEAKRLLNNDNTAGTDGPRDRRAVDRDMESGWLKGQRQLLDLDSLSFHQGGLLMANKKCELPEGSFRTPHKGYEEVHVPALKARPYGAGEKIVKISDMPGWAQPAFAGMQQLNRVQSRVYDTALFKPDNILLCAPTGAGKTNVAVLTILHQIGLHMKDGEFDNTKYKIVYVAPMKALVAEVVGNLSARLKDFNVTVRELSGDQNLTKQQIDETQIIVTTPEKWDIVTRKSGDRTYTQMVKLLIIDEIHLLHDNRGPVLESIVSRTVRQIETTKEHIRLVGLSATLPNYEDVAVFLRVRSEGLFHFDNSYRPCPLAQQYIGITVRKPLQRFQLMNEICYEKVMAAAGKHQVLIFVHSRKETAKTARAIRDTALANDTLTRFLKDESASQEILSSQAELVKSSDLKDLLPYGFAIHHAGMARVDREFVEELFADKHIQVLVSTATLAWGVNLPAHTVIIKGTQIYNPEKGAWTELSPLDVMQMLGRAGRPQYDTHGEGIILTGHSELQYYLSLMNQQLPIESQFVSKLADQLNAEIVLGTIQNAREACSWLGYTYLYIRMLRNPTLYGLPADIMETDKTLDERRADLVHSAANLLDKNNLIKYDRKTGYFQVTDLGRIASYYYISHGTISTYNEYLKPTMGDIELCRLFSLSEEFKYVSVRQDEKMELAKLLDRVPIPVKESLEEPSAKINVLLQAYISRLKLEGLSLGSDMVYIRQSAGRLLRALFEIVLKRGWAQLAEKALNLCKMIDKQMWSVQTPLRQFPGIPKEILMKLEKKELVWERYYDLSSAEIGQLIRFDKMGKQLHRCIHQLPKLNLSAHVQPITRTVLGFELTITPDFQWDDKVHGYVEAFWVIVEDNDGEYILHHEYFMLKKQYVEEDHTLHFTVPIYEPLPPQYFIRVVSDKWLGSQTILPVCFRHLILPEKYAPPTELLDLQPLPVTALRNARYEGLYSAFKHFNPIQTQVFTVLYNSDDTVLVAAPTGSGKTICAEFAILRNHQKALSGETNMRVVYIAPIEALAKERYRDWSKKFGEFARVVELTGETAADLKLLDKGEIIISTPEKWDALSRRWKQRKHIQQVSLFIVDELHLIGSEKGHVLEIIVSRMRRISSHIGSNIRIVALSASLGNAKDLGEWIGATAHGLFNFPPAVRPVPLEIHIQGVDIANFEARMQAMAKPTYTAVTQHAKNGKPALVFVPTRKHARLTALDLCAYSSAEGAGTPFLLGSKDEMDTFTGGVNEETLKNTLKCGVGYLHEGLSELDQELVTQLFLGGRIQVCVASSTMCWGRSLPAHLVVVMGTQYYDGRESAHTDYPITDLLQMMGHASRPLQDNSGKCVILCHAPRKEYYKKFLFEAFPVESHLHHFLHDHMNAEVVVGVVENKQDAVDYLTWTFMYRRLNKNPNYYNLQGVSHRHLSDHLSELIETVLTDLESSKCVAVEEDMYLKPLNLGLIAAYYYISYTTIERFSSMLTQKTKMKGLLEILASASEYAELPSRPGEEEYIERLVRHQRFSIEKPKYGDPHVKANALLQSHFARHTVVGNLAADQREILLSAHRLLQAMVDVISSNGWLSLALNAMELSQMVTQGMWDRDSVLLQIPHFTRELARRCQENEGKPIESIFELAEMGIDEMRDLLQLSNSELHDVVEFFKRFPNIDMAYEVREGDDIRAGDSVTLQVTLERDMTNLPSEVGPVHAPRFPKPKEEGWWLVVGDFSTKQLLAIKRVALQKRARVKLEFTAAAEPGQKEYMIYLMSDSYLGCDQEYEFTIDVKDAGAD

SEQ ID NO: 5988 - protein, 2146 aa, Triticum aestivum
PRDTHEPTGEPETLWGRIDKRSFGDRAVQAKPPELEDRLTKSRKKKERDAAASAGDADADQPRKRRRRSSAAQREESVLSLADDVVYKPQTKETRAAYEAMLSVIQQQFGGQPLDVLGGAADEVLAVLKNDKIKNPDKKKEIEKLLNPISSAMFDQFVSIGKLITDFHDASDPAAAPSGDGGDATMDDDIGVAVEFEEDEDDEESDFDQVQDDLDDDDDDVAELNRPGGMQMGGELDDDDMQNSNEGLNINVQDIDAYWLQRKITQAYEDIDPQQSQKLAEEILKIIAVGDDRDVENRLVMELDYEKFDLIKLVLRNRFKIVWCTRLARAEDQEERKKIEEEMMDNPSLAPILEQLHATRASAKERQKNLEKSIRDEAKRLLNNDSAGADGPRERRAVERDTESGWLKGQRQLLDLDSLSFHQGGLLMANKKCELPEGSFRTPHKGYEEVHVPALKPRPYGTGEKIVKISDIPGWAQPAFAGMQQLNRVQSKVYDTALFKPDNILLCAPTGAGKTNVAVLTILHQIGLHMKDGEFDNSKYKIVYVAPMKALVAEVVGNLSARLKDFNVNVRELSGDQNLTKQQIDDTQIIVTTPEKWDIVTRKSGDRTYTQMVKLLIIDEIHLLHDNRGPVLESIVSRTVRQIETTKEHIRLVGLSATLPNYEDVAVFLRVRSEGLFHFDNSYRPCPLAQQYIGITVRKPLQRFQLMNEICYEKVMASAGKHQVLIFVHSRKETSKTARAIRDTALANDTLTRFLKDESASQEILGSHTDIVKSSDLKDLLPYGFAIHHAGMARVDRELVEELFADKHIQVLVSTATLAWGVNLPAHTVIIKGTQIYNPEKGAWTELSPLDVMQMLGRAGRPQYDTHGEGIILTGHSELQYYLSLMNQQLPIESQFVSKLADQLNAEIVLGTIQNAREACSWLGYTYLYIRMLRNPTLYGLPADIMETDKTLDERRADLVHSAANLLDRNNLIKYDRKTGYFQVTDLGRIASYYYISHGTISTYNEYLKPTMGDIELCRLFSLSEEFKYVSVRQDEKMELAKLLDRVPIPVKESLEEPSAKINVLLQAYISRLKLEGLSLGSDMVYIRQSAGRLLRALFEIVLKRGWAQLAEKALNLCKMIDKQMWSVQTPLRQFPGIPKEILMKLEKKELAWERYYDLSSQEIGELIRFQKMGKQLHRCIHQLPKLNLSAHVQPITRTVLGFELTITPDFLWDDKVHGYVEPFWVIVEDNDGEYILHHEYFMLKKQYVDEDHTLHFTVPIYEPLPPQYFIRVVSDKWLGSQTILPVCFRHLILPEKYAPPTELLDLQPLPVTALRNARYEGLYSAFKHFNPIQTQVFTVLYNSDDSVLVAAPTGSGKTICAEFAILRNHQKAVSGETNMRVVYIAPIEALAKERYRDWSKKFGEFARVVELTGETAADLKLLDKGEIIISTPEKWDALSRRWKQRKPVQQVSLFIVDELHLIGSEKGHVLEIVVSRMRRISSHIGSNIRIVALSASLGNAKDLGEWIGATAHGLFNFPPAVRPVPLEIHIQGVDIANFEARMQAMAKPTYTAITQHAKSGKPALVFVPTRKHARLTALDLCAYSSAEGGGTPFLLGSQDEMDTFIGGVNEETLKNTLRCGVGYLHEGLSDLDQELVTQLFLGGRIQVCVASSTMCWGRSLPAHLVVVMGTQYYDGRESAHTDYPITDLLQMMGHASRPLQDNSGKCVILCHAPRKEYYKKFLFEAFPVESHLHHFLHDHMNAEVVVGVVENKQDAVDYLTWTFMYRRLNKNPNYYNLQGVSHRHLSDHLSELIETVLNDLESSKCVAVEEDMYLKPLNLGLIAAYYYISYTTIERFSSMLTQKTKMKGLLEILASASEYAELPSRPGEEEYIERLVRHQRFSIDKPKYGDPHVKANALLQSHFARHTVVGNLAADQREILLSAHRLLLAMVDVISSSGWLTLALNAMELSQMVTQGMWDRDSVLLQLPHFTRDLARRCQENEAKPIESIFDLAEMSIDEMRDLLQLSNSELQDVVQFFKRFPNVDMTYEVREGDDIRAGDNVTLQVTLERDMTNLPNSEVGPVHAPRFPKTKEEGWWLVVGDSSTKQLLAIKRVTLQKRARVKLEFTAAVEPGSKDYMIYLMSDSYLGCDQEYEFTVDIKEAGGD

SEQ ID NO: 5989 - protein, 2176 aa, Sorghum bicolor
MANLGGGGGAEAHARFKQYEYRANASLVLTTDSRPRDTHHEPSGEPQTQWNRIDPKSFGDRAVQNKPPPELEEKLSRSRTRKAKRDAANTGLPRRDAKRRRRAASDRGISVLSLTDDAVYMPQTKETSAVYDALLSLIQQKLGGQPLDVLAGAAEEVLATLKNDKVKNPDKKKAIEQLLGTTSNRLFDQLVSIGKLITDFHDVAASNAGAGAPFADAMDTTLDDNVSFAVGWEENEDDESGSDQVQDELDDDNEDDTTELNGLEGMQMDSALDDNDMQNANQGLAVNVQDIDAYWLQRKIFQAYGDGDIDVQQSQKLAENILKIIAKGDDRDVENHLVMLLDYEKFDLIKLLLRNRLKVVWCTRLARAEDQEQRKNIEEEMINDPSLAPILEQLHATRASAKERQENVEKSIRDEAKRLLNNDGVSNRRAAEGDMESEWFKGQKRLLDLDSLSFHQGGLFMSIKKCELPTGSFRISHKGYEEVHVPAPKAKPYETGEKIVKISDMPEWAKPAFDGMTQLNRIQSRVYDTALFKPDNILICAPTGAGKTNVAVLTILQQIGLHMKDGEFENTKYKIVYVAPMKALVAELVGNLSKRLAYYNVTVKELSGDQNLTKQQIDETQVIVTTPEKWDIVTRKSGDRTYTQLVKLLIIDEIHLLHDNRGPVLESIVARTVRQIETTKVHIRLVGLSATLPNHDDVALFLRVHKVNLFYFDNCYRPCPLAQQYIGITVRKPLQRIWLMNEICYEKVMASAGKHQVLIFVHSRKDTAKTAKAIRDLALANNTVSCFLKNESASQEILGTHADLVDNNDLKDLLPYGFAIHHSGMARVDRELVEELFADKHIQVLVSTTTLAWGVNLPAHTVIIKGTQIYSPEKGAWTELCPLDVLQMLGRAGRPQYDTNGEGIILTSHSELLFYLSLMNQQLPIESQFISKLADQLNAEIVLGTIQNAREACSWLGYTYLYIRMLRDPTLYGLPADILERDKTLEERRADLIHSAANLLDKNNLIKYDRKTGYFQVTDLGRIASYHYISHRTISKYNECLKPTMGDIELCRLFSLSEEFEHVGARLDEKMELGKLLDRVPIPVKESLEDPSAKINVLLQAYISRLKPEGLSLSSDMVYIIQSAGHLLRALFEIVLKRGWAQLAEKALNLCKAVDKQMWSVQTPLWQFPGIPTEVLMKLEKKELAWERCYDLSSQELGELICYPKMGRLLHKCIHQLPKLNLSAHVQPITPTVLSFELTVTPDFQWDDKVHGYVEPFWVIVEDNNGESILHHEYFLLKKQYVDEDHTLNFTVPIYEPLPPKYFVHIVSDKWLGSKTILPACFSHLILPEKYAPPTQLLDLQPLPVNALRNAQYEGLYSAFKHFNPIQTQVFTVLYNSDDSVLVAAPTGCGKTTCAEFAILRNHQRAVSGESNMRVVYIAPIEALAKERYRDWGHKFAEFAKVVELTGETTADLKLLDKGEIIISTPEKWDALSRRWKQQKHIQQVSLFIVDELHLLGSDKGHVLEVIVSRMRRISSHIASNIRIVALSASLGNAKDLGEWIGATSHGLFNFPPALRPMPLEVHIQSVDIANFEARMQAMTKPAYTAIKQHTKNGKPALVYVPTSKHARLTALDLCAYSSVEGGGAPFLLGSEDEMDAFTRGVEEEMLKNTLKCGVGYLHQGLSELDQELVTNLLLGGRIQVCVVSSTMCWRRLLPVHLVVIMGTRYCDGCENARKDYPIADLLQMMGHATLQDNSGKCVILCHAPRKEYYKRFLSEAFLVESNLHHFLHDHMSAEVVAGVVENKQDAVDYLTWTFMYRRLTKNPNYYNLQGVSHRHLSDHLSELVETVLNDLESSKSVAIEDKYLKPLNLGLIASYYYISYTTIKHFGSMLTQKTKMKGLLEILASASEYAELAGHAGEEEFIEKLVHHQRFSIEKPKYGDPHVKANVLLQAHFSRHTVVGNLAADQRKILISTHRLLQAMVDVISSNGWLSLALSAMELSQMVTQGMWDRDSVLLQVPHFTKDLAQRCQENEVKPIESIFDLAEMGIDEMRDLLQLSNSQLKDIIEFFKRFPNVDMVYEVREGDDTSAGDNVAVQVTLERDMADLPCEVGPVHAPRFPKPKEEGWWLVIGDSSTNQLLAIKRVALQKRARMKLEFSAPAEAGTMDYTIYLMSDSYLGCDQEHKFTVDIKDAGGDL

SEQ ID NO: 5990 - protein, 2051 aa, Triticum aestivum
ADAGAMLSVIQQQFGGQPLDVLGGAADEVLAVLKNDKIKNPDKKKEIEKLLNPISSAMFDQFVSIGKLITDFHDASDPAAAPSGDGGDATMDDDIGVAVEFEEDEDDEESDFDQVQDDLDDDDDDVAELNRPGGMQMGGELDDDDMQNSNEGLNINVQDIDAYWLQRKITQAYEDIDPQQSQKLAEEILKIIAVGDDRDVENRLVMELDYEKFDLIKLVLRNRFKIVWCTRLARAEDQEERKKIEEEMMDNPSLAPILEQLHATRASAKERQKNLEKSIRDEAKRLLNNDSAGADGPRERRAVERDTESGWLKGQRQLLDLDSLSFHQGGLLMANKKCELPEGSFRTPHKGYEEVHVPALKPRPYGTGEKIVKISDIPGWAQPAFAGMQQLNRVQSKVYDTALFKPDNILLCAPTGAGKTNVAVLTILHQIGLHMKDGEFDNSKYKIVYVAPMKALVAEVVGNLSARLKDFNVNVRELSGDQNLTKQQIDDTQIIVTTPEKWDIVTRKSGDRTYTQMVKLLIIDEIHLLHDNRGPVLESIVSRTVRQIETTKEHIRLVGLSATLPNYEDVAVFLRVRSEGLFHFDNSYRPCPLAQQYIGITVRKPLQRFQLMNEICYEKVMASAGKHQVLIFVHSRKETSKTARAIRDTALANDTLTRFLKDESASQEILGSHTDIVKSSDLKDLLPYGFAIHHAGMARVDRELVEELFADKHIQVLVSTATLAWGVNLPAHTVIIKGTQIYNPEKGAWTELSPLDVMQMLGRAGRPQYDTHGEGIILTGHSELQYYLSLMNQQLPIESQFVSKLADQLNAEIVLGTIQNAREACSWLGYTYLYIRMLRNPTLYGLPADIMETDKTLDERRADLVHSAANLLDRNNLIKYDRKTGYFQVTDLGRIASYYYISHGTISTYNEYLKPTMGDIELCRLFSLSEEFKYVSVRQDEKMELAKLLDRVPIPVKESLEEPSAKINVLLQAYISRLKLEGLSLGSDMVYIRQSAGRLLRALFEIVLKRGWAQLAEKALNLCKMIDKQMWSVQTPLRQFPGIPKEILMKLEKKELAWERYYDLSSQEIGELIRFQKMGKQLHRCIHQLPKLNLSAHVQPITRTVLGFELTITPDFLWDDKVHGYVEPFWVIVEDNDGEYILHHEYFMLKKQYVDEDHTLHFTVPIYEPLPPQYFIRVVSDKWLGSQTILPVCFRHLILPEKYAPPTELLDLQPLPVTALRNARYEGLYSAFKHFNPIQTQVFTVLYNSDDSVLVAAPTGSGKTICAEFAILRNHQKAVSGETNMRVVYIAPIEALAKERYRDWSKKFGEFARVVELTGETAADLKLLDKGEIIISTPEKWDALSRRWKQRKPVQQVSLFIVDELHLIGSEKGHVLEIVVSRMRRISSHIGSNIRIVALSASLGNAKDLGEWIGATAHGLFNFPPAVRPVPLEIHIQGVDIANFEARMQAMAKPTYTAITQHAKSGKPALVFVPTRKHARLTALDLCAYSSAEGGGTPFLLGSQDEMDTFIGGVNEETLKNTLRCGVGYLHEGLSDLDQELVTQLFLGGRIQVCVASSTMCWGRSLPAHLVVVMGTQYYDGRESAHTDYPITDLLQMMGHASRPLQDNSGKCVILCHAPRKEYYKKFLFEAFPVESHLHHFLHDHMNAEVVVGVVENKQDAVDYLTWTFMYRRLNKNPNYYNLQGVSHRHLSDHLSELIETVLNDLESSKCVAVEEDMYLKPLNLGLIAAYYYISYTTIERFSSMLTQKTKMKGLLEILASASEYAELPSRPGEEEYIERLVRHQRFSIDKPKYGDPHVKANALLQSHFARHTVVGNLAADQREILLSAHRLLLAMVDVISSSGWLTLALNAMELSQMVTQGMWDRDSVLLQLPHFTRDLARRCQENEAKPIESIFDLAEMSIDEMRDLLQLSNSELQDVVVFFKRFPNVDMTYEVREGDDIRAGDNVTLQVTLERDMTNLPNSEVGPVHAPRFPKTKEEGWWLVVGDSSTKQLLAIKRVTLQKRARVKLEFTAAAEPGTKDYMIYLMSDSYLGCDQEYEFTIDIKEAGGD

SEQ ID NO: 5991 - protein, 1314 aa, Secale cereale
PISSAMFDQFVSIGKLITDFHDASDPAAAPSGDGGDATMDDDIGVAVEFEEDEDDEESDFDQVQDDLDDDDDDVAELNRPGGMQMGGELDDDDMQNSNEGLNINVQDIDAYWLQRKITQAYEDIDPQQSQKLAEEILKIIAVGDDRDVENRLVMELDYEKFDLIKLVLRNRFKIVWCTRLARAEDQEERKKIEEEMMDNPSLAPILEQLHATRASAKERQKNLEKSIRDEAKRLLNNDSAGADGPRERRAVDRDTESGWLKGQRQLLDLDSLSFHQGGLLMANKKCELPEGSFRTPHKGYEEVHVPALKPRPYGTGEKIVKISDIPGWAQPAFAGMQQLNRVQSKVYDTALFKPDNILLCAPTGAGKTNVAVLTILHQIGLHMKDGEFDNSKYKIVYVAPMKALVAEVVGNLSARLKDFNVNVRELSGDQNLTKQQIDDTQIIVTTPEKWDIVTRKSGDRTYTQMVKLLIIDEIHLLHDNRGPVLESIVSRTVRQIETTKEHIRLVGLSATLPNYEDVAVFLRVRSEGLFHFDNSYRPCPLAQQYIGITVRKPLQRFQLMNEICYEKVMASAGKHQVLIFVHSRKETSKTARAIRDTALANDTLTRFLKDESASQEILGSHTDIVKSSDLKDLLPYGFAIHHAGMARVDRELVEELFADKHIQVLVSTATLAWGVNLPAHTVIIKGTQIYNPEKGAWTELSPLDVMQMLGRAGRPQYDTHGEGIILTGHSELQYYLSLMNQQLPIESQFISKLADQLNAEIVLGTIQNAREACSWLGYTYLYIRMLRNPTLYGLPADIMETDKTLDERRADLVHSAANLLDRNNLIKYDRKTGYFQVTDLGRIASYYYISHGTISTYNEYLKPTMGDIELCRLFSLSEEFKYVSVRQDEKMELAKLLDRVPIPVKESLEEPSAKINVLLQAYISRLKLEGLSLGSDMVYIRQSAGRLLRALFEIVLKRGWAQLAEKALNLCKMIDKQMWSVQTPLRQFPGIPKEILMKLEKKELAWERYYDLSSQEIGELIRFPKMGKQLHRCIHQLPKLNLSAHVQPITRTVLGFELTITPDFLWDDKVHGYVEPFWVIVEDNDGEYILHHEYFMLKSNTWMKITHFTLQLPIYEPLPPQYFIRVVSDKWLGSQTILPVCFRHLILPEKYAPPTELLDLQPLPVTALRNARYEGLYSAFKHFNPIQTQVFTVLYNSDDSVLVAAPTGSGKTICAEFAILRNHQKAVSGETTMRVVYIAPIEALAKERYRDWSKKFGEFARVVELTGETAADLKLLDKGRSLLVLLKSGMHFLAGGSRGNLSSKSVYLLLMSFI

SEQ ID NO: 5992 - protein, 1921 aa, Musa acuminata
MQMGGIDDEDMEEANEGQTINVQDIDAYWLQRKISQAYEEIDPQQSQKLAEEVLKILAEGDDRDVENRLVMLLDYDKFELIKLLLRNRLKIVWCTRLARAEDQDQRKKIEEEMSNMGPTLTTILEQLHATRASAKERQKNLEKSIREEARRLKDEHGGGDNDRDRRVVDRDTDSGWLKGQCQLLDLDSIAFHQGGLLMANKKCELPPGSYRTPHKGYEEVHVPALKPKTFSPEEKLVKISDLPDWAQPAFEGMKQLNRVQSMVYKTAFTSPENILLCAPTGAGKTNVAMLAILHQIGLHRRDGVLDNSKYKIVYVAPMKALVAEVVGNLSHRLKSYNIVVRELSGDQNLTRQQIEETQIIVTTPEKWDIVTRKSGDRTYTQLVKLLIIDEIHLLHDNRGPVLESIVARTLRQTEATKELIRLVGLSATLPNYEDVALFLRVTKPSGILHFDNSYRPCPLAQQYIGITIKKPLQRFQLMNEICYEKVMAAAGKHQVLIFVHSRKETAKTARAIRDTALANDTLSRFLKDDSASREILQSQTEFVKSNDLKDLLPYGFAIHHAGMARVDRDLVEELFSDGHVQVLVSTATLAWGVNLPAHTVIIKGTQIYNPEKGAWTELSPLDVMQMLGRAGRPQYDSYGEGIILTGHSELQYYLSLMNQQLPIESQFVSKLADQLNAEIVLGTVQNAREACNWIGYTYLYVRMVRNPTLYGLSADILERDKLLEERRADLIHTAANILDKNNLVKYDRKSGYFQATDLGRIASYYYITHGTISTYNEYLKPTMGDIELFRLFSLSEEFKYVTVRQDEKMELAKLLDRVPIPVKESLEEPSAKINVLLQAYISQLKLEGLSLTSDMVFIKQSAGRLIRSLFEIVLKRGWAQLAEKALNLCKMVDKRMWSVQTPLRQFTGIPNEILMKLEKKDLSWERYYDLSSQEIGELIRYPKMGRQLHKCIHQLPKLNLLAHVQPITRTVLGFELTITPDFQWDDAVHGYVEPFWVIVEDNDGEYILHHEYFMLKKQYIDEDHTLNFTVPIYEPLPPQYFIRVVSDKWLGSQTVLPVCFRHLILPEKYPPATELLDLQPLPVTALRNPAYEALYDAFKHFNPIQTQVFTVLYNTDDNVLVAAPTGSGKTICAEFALLRNHQKGPDSIMRAVYIAPIEAVAKERYRDWEEKFGKRLGIRVVELTGETATDLKLLERGQIIISTPEKWDALSRRWKQRKQVQQVSLFIVDELHLIGGEMGPILEIIVSRMRRIASHIGSNIRIVALSASLANAKDLGEWIGATSHGLFNFPPGVRPVPLEIHIQGVDISNFEARMQAMTKPTYTAIVQHSKNGKPALVFVPTRKHARLTALDLCTYSHADRGERPSFLLGSGEEMNTFISGIKDDTLKGTLALGVGYLHEGLNEFDQEVVIQLFLGGRIQVCVATSLMCWGRSLPSHLVVVMGTQYYDGRENAHTDYPITDLLQMMGHASRPLKDNSGICVILCHAPRKEYYKKFLYEAFPVESHLHNFLHDHMNAEVVVGVTENKQDAVDYLTWTFMYRRLTKNPNYYNLQGVSHRHLSDHLSELVENVLSDLESSKCVAIEEDMYLKPLNLGLIASYYYISYTTIERFSSSLTSKTKMKGLLDILASASEYSQLPIRPGEEELIRKLINHQRFSFENPKCTDPHVKANVLLQAHFSRHTVVGNLAADQREVLLSAHRLLQAMVDVISSNGWLSLALSTMELSQMVTQGMWERDSMLLQIPHFTKELAKRCQENPGRSIETVFDLVEMEDDERRDLLQMLDSQLLDIARFCNRFPNIDMTYEVLDDDDVRPGENVTLQVTLERDLEGRAEVGPVDAPRYPKAKEEGWWLVVGDTGNNQLLAIKRVALQRKAKVKLVFTAPAEVGKKAFTIYFMCDSYLGCDQEYNFNIDVKEGGEDGNRSD

SEQ ID NO: 5993 - protein, 2144 aa, Oryza sativa
MAKPGSGGGAEAHARSRKYDYVENSNLVLGSGSGSRPRGGADEHTGEPETLRGRIDPRSFGDRAVQAKPPVEPPRRRKARDAADHDIGHRLDAKRRRRAASACTAQREVSVLTLIDDVVYRPRTKETRAAYEALLSVIQRQLGGQPPDVLGSAADEVLAILNNDKIKSPEKKRGIDKFLDPISDQMFHQFVSIGKLITDFHDTAVCDSASELDENFGVAVEFEQNEDDEGSDSDQVLDDLDEDDGDTMLNAAGAMQIGDELDDDDMHNSNEELAINAQDIDAYWLQRKVSQAYEDIDPQVSQELSLEIMSFLSESDDKDVENRLVTLLGYDNFDFIKLLVRNRLKIFWCTCLARAEGQEKRKMIEENMLSDPTLSPILEQLHATRVSAKDRLKNMEKSIRDEAKRLTEKQNAGINGARDQRVVKRDMESGWLKGQKQLLDLENLTFHQGGLLMVNKKCELPPGSFRTPHNGYEEVHVPALKAKPYENGEKVVKISDMPDWAQPAFAGMTQLNRIQSKVYDTALFKPDNIILCAPTGAGKTNVAVLTILQQIGLHMKDGEFDNTKYKIVYVAPMKALVAEVVGNLSARLKEYNITVRELSGDQNLTKQQIDETQIIVTTPEKWDIVTRKSEGLFWRALFRSVRQTETTKEHIRLVGLSATLPNYQDVAVFLRVHSGGLFHFDNSYRPCPLAQQYIGITVKKPFQRFQLMNQICYEKVMAAAGKHQVLIFVHSRKETAKTARAIKDIALSNNKLTCFPKVESASLEILADHANHVKSNDLKDLLPYGFGIHHAGLTRVDRELIEGLFADKHLQALVSTATLAWGVNLPAHTVIIKGTQVYNPEKGAWTELSPLDVMQMLGRAGRPQYDTHGEGIILTEQSELQYYLSLMNQQLPIESQFISRLADHLNAEIVLGTIQNVREACTWLGYTYLYIRMLRNPTLYGLPADIMETDNTLDERRVDLVHAAANILDWNNLIKYDRKTGYFQVTDLGRIASYYYVSHRTISTYNECLKPTMGDIELCRLFSLSEEFKYVSVRQDEKMELAKLFNCVPIPVKESLDEPSAKINVLLQAYISRLELEGLSLSSDMVYIRQNAGRLLRALFEIVLKRGWAQLAEKALNLCKMIDKHIWNVQIPLHQFPSIPKEILMKLEKKELAWERYFDLSSQEIGELIRNPKMGMQLHKCIHQLPKLNLSAHVQPITPTVLGFELTITADFQWDDELHGYVEPFWLIVEDNGGDNILHHEYFMLKKQYVDEDHTLNFTVPIYEPLPPQYFIRVVSDKWLGSQTILPVSFRHLTLPEKYAPPTELIDLQPLPVTALRNARYESLYCAFKHFNPIQTQVFTASYNSDDSVLVAAPTGSGKTICAEFAILRNHQKAVSGDSNMRVVYVAPIEALAKERYKDWESKFGELARVVELTGETAADLKLLDKGEIIISTAEKWDALSRRWKQRKNVQQVSLFIFDELHLIGSENGHILEIIISRMRHMANHIGSNIRIVALSASLANGKDLGEWIGTSSHSLFNFPPAVRPLPLEIHIQGWDVAIFEARMQAMSKPTYTAITQHAKHGKPALVFVPTHKHARLTAVDLCAHSSAESGGTPFLLGSEDEMDTFTSGVNDEALKYTLKCGVGYLHEGLSDFDQELVTQLFLGGRIQVCVASSKMCWGRSLPSHLVVVMGTQYYDGRGNSHTDYPVTDLLQMMGHANRPLQDDSGKCVILCYAPRKEYYKKFLFEAFPVESHLQHFLHDHMNAEVVAGLIENKQDAVDYLTWTFMYRRLAKNPNYYNLQDVSHRHVSEHLSELVETVLNDLESTNCLAIEENIYLKTLNLGLIASYYYVTYTTIERFSSMLTQKTKLKGLLEILASASEYADLPSRPGEQKSIERLVHHQRFSVEKKVRYDDPHVKANALLQCHFSRRTVEGDLAADQREILLPAHRLLQALIDVISSNGWLTLALNAMELSQMVTQGMWDRDSVLLQLPHFTEELARRCQENEGKAIETIFDLAEMSTHEMQDLLQLPSSQLQDIVGFLRRFPNIDMAFQVLEGDGGSVTVQVTLEREMADLLQSEAGPVHAPRFPKPKEEGWWLVIGDRSTDQLLAIKRVKLQKRARVKLEFAAPAEAGRKDYMVYLMSDSYLGCDQEYEFAVDVKDAGGD

SEQ ID NO: 5994 - protein, 497 aa, Brachypodium distachyon
MRRIANHICSNIRIVALSASLANAKDLGEWIGASSRGFFNFPPAVRPVPLEIHIQSVDLANFEARMQAMAKPTYNAIRQHAKHGKPALVFLPTHRHARFTALDLCAYSSAEGCVTPFLLGSQDEIDTHTQGLSEDTLKNTLKCGVGYLHEALGDLDQEVVTQLFLCGKIQVCVVSSTMCWGRSLPSHLVVVMGTQYCDDRERANADYSITDLLQMIGHASRPLKDNSGKFVILCHAPRKEYYKKFLLEAFPVESHLQHFLHDHMNAEVAVGVVENKQGALDYLSWTFMYRRLTKNPNYYNLQGVGNKHMSDHLSELIETVLEDLESTNCVAIEEDTYLKPLNLGLIVSCYYISYMTIERFSLMLTQKTKMKDILEILASASEYAQLPSRGGEEEFIERLVRHQTYSVDNPKYCDPHIKANALLQAHFSRHTVVGNLAVDQRGVLLYAHRLLQAIVDVASSNGWLSLALNTIELSQMVTQGMWDRDSGCFNSHTSPRS

SEQ ID NO: 5995 - protein, 299 aa, Zea mays
MVLLRVCRHFGHLRFASFLSMAAPQQSAPLSGSAPKRLRAMATDAAAVPNPPASSGCPAMKAEFAKHAEYLNTLNDKRERLVKASRDITMNSKKVIFQVHRITKVNRDEVLSKAENDLAAVVNQYIAKLVKELQGTDFWKLRRAYTFGVQEYVEAATLCRFCKTGTLLSLAEINDSLLALSGQSVEPLQLNVLDYLLGVADLSGELMRLAIGRISDGEVEYAKTICAFVRDIYRELTLVVPLMDDNSEMKKKMEVMLQSVVKIENACFSVHVRGSEYIPLLESSADPGYSYFGAPDFDQ

SEQ ID NO: 5996 - protein, 259 aa, Saccharum officinarum
MATDVAAAADPPASRGCPAMKAEFAKHAEYLNALNDKRERLVKASRDVTMNSKKVIFQVHRITKVNRDEVLSKAENDLAAVVNQYIAKLVKELQGTDFWKLRRAYTFGVQEYVEAATLCRFCKTGTLLSLAEINDSLLALSDKSVEPLQLNVLDYLLGVADLSGELMRLAIGRISDGEVEYAKTICAFVRDIYRELTLVVPLMDDHNEMKKKMEVMLQSVVKIENACFSVHVRSSEYIPLLGSSADPDYSFFGASDFDK

SEQ ID NO: 5997 - protein, 428 aa, Saccharum officinarum
MKVDVVGTTLVAPSEDTPRRELWLSNLDLAVPKTHTPLVYYYPAPAADGAAFFAPERLEAALARALVPFYPLAGRLGVGEGGRLQIDCDAQGALFVVARADFAGDDVFNDDYEPSPEVRRMFVPFAASGDPPCVMAMFQVTFLKCGGVVLGTGIHHVTMDGMGAFHFIQTWTGVARGLDTAEACGPLPPFHDRTLLGARSPPTPAFDHPVYSPALLNGHPRPFVTRMYAVSPKLLADIKSRCAPGVSTYCAVTAHLWRCMCVARGLAPGSDTRLRVPANVRHRLRPPLPRSYFGNAIVRDLVVARVEDVLKRPLGFVAQAIRDAVDRVDDAYVRSVVDYLEVEAEKGGQAARGQLMPESDLWVVSWLGMPMYDADFGWGTPRFVAPAQMFGSGTAYVTQRANKDDGIAVLFGLEPEYLQCFEKVFYGE

SEQ ID NO: 5998 - protein, 431 aa, Zea mays
MKVDVVGTTLVAPSEDTPHPELWLSNLDLAVPKTHTPLVYYYPAPAAGGDTDGEAAFFAPERLEAALAKALVPFYPLAGRLGVGEGGRLQIDCTGEGALFVVARADFAGEDVFSDYEPSPEVRRLFVPFAASGDPPCVMSMFQVTFLKCGGVVLGTGIHHVTMDGMGAFHFIQTWTGVARGLDTAEACGPLPFHDRTLLRARSPPAPAFDHPVYSPALLNGVPRPFVTRVYAVSPKLLAGIKSRCAPGVSTYCAVTAHLWRCMCVARGLAPGSDTRLRVPANVRHRLRPPLPRSYFGNAIVRDLVTTRVEDVLERPLGFVAQAIKDAVDRVNDAYVRSVVDYLEVESEKGSQAARGQLMPESDLWVVSWLGMPMYDADFGWGTPRFVAPAQMFGSGTAYVTQRANRDDGLAVLFGLEPEYLQCFEKVFYGE

SEQ ID NO: 5999 - protein, 432 aa, Setaria italica
MKVDVMETTLVAPSEDTPRRELWLSNLDLAVPKTHTPLVYYYPASELGAGVGPEGSFFAAERLKAALARALVPFYPLAGRLGVGEGGRLQIDCNAEGALFVVAQADFAGDNVFRDYEPSPEVRRMFVPFVPSGDPPCVMAMFQVTFLKCGGVVLGTGIHHVALDGMGAFHFIQTWTGVSRGLGTAEACGPPPFHDRTLLRARSPPAPAFHHPVYSPALLSGRPRPFVTRVYSVSPKLLADLKSRCAPGASTYCAVTAHLWRAMCAARGLAPGVDTRLRVPANVRHRLRPPLPRSYFGNAIVRDLVTARVEDVLARPLGFVARAIGDAVGRVDDAYARSVVDYLEVESEKGGQAARGQLMPETDLWVVSWLGMPMYDADFGWSAPRFVAPAQMFGSGTAYVTQHASKDDDGITVQFALEPEYLQCFEKVFYGE

SEQ ID NO: 6000 - protein, 435 aa, Leymus cinereus x Leymus triticoides
MKVEVVESTLVAPSEETPRRELWLSNLDLAVPKTHTPLVYYYPAPATAAPDTDSADFFSPERLKAALARALVLFYPLAGRLGREGEGGRLQIDCTGEGALFVVARAPDVAGDDLFGSSYEPSPEVRRMFVPFAPSGDPPCLMAMFQVTFLKCGGVVLGTGIHHVTMDGMGAFHFIQTWTGLARGLALSEACPSPPFHDRTLLRARSPPRPEFDHPVYSPAYLNGTPRPFVTRVYSVSPKLLADLKSRCGPGVSTYGAVTAHLWRCMCVARGLAPGSDTRLRVPANIRHRLRPPLPRQFFGNAIVRDLVTVKVGDVLSQPPGYVADTIRKAVEHVDDAYTRSVIDYLEVESEKGSQAARGQLMPESDLWVVSWLGMPMYDADFGWGAPRFVAPAQMFGSGTAYVTQRGADRDDGIAVLFALEPEYLQCFQDVFYGE

SEQ ID NO: 6001 - protein, 435 aa, Triticum aestivum
MKVEVVESTLVAPSEETPRRALWLSNLDLAVPKTHTPLVYYYPAPATAAPDTDSADFFSPERLKAALAKALVLFYPLAGRLGREGEGGRLQIDCNGEGALFVLARAPDVAGEDLFGSGYEPSPEIRRMFVPFAPSGDPPCHMAMFQVTFLKCGGVVLGTGIHHVTMDGMGAFHFIQTWTGLARGLSLSEACPSPPFHDRTLLRARSPPRPEFEHPVYSPAYLNGAPRPFVTRVYSVSQKLLADIKSRCAPGVSTYGAVTAHLWRCMCVARGLAPGSDTRLRVPANIRHRLRPQLPRQFFGNAIVRDLVTVKVGDVLSQPLGYVADTIRKAVDHVDDAYTRSVIDYLEVESEKGSQAARGQLMPESDLWVVSWLGMPMYDADFGWGAPRFVAPAQMFGSGTAYVTQRGADRDDGIAVLFALEPEYLQCFQDVFYGE

SEQ ID NO: 6002 - protein, 432 aa, Avena sativa
MKVEVVESTLVAPSEETPRLGLWLSNLDLAVPKTHTPLVYYYPAPTPPAPGGADSEDFFSPDRLRAALAKALVLFYPLAGRLGVDEGGRLQIDCNGEGALFVVAKADCTGEDLFGKYEPSPEIRRLFVPFTPSGDPPCLMAMFQVTFLKCGGVVLGTGIHHVTMDGAGAFHFIQTWTGLARGLAVSEACPSPPSHDRTLLRPRSPPHADFDHPVYSPAYLNGVPRSFVTRVYSVSPKLLADLKSRCAPGVSTYGAVTAHLWRCMCVARGLAPESDTRLRVPANIRHRLRPSLPPQYFGNAIVRDLVTVKVGDVLAQPLGFVAETIRKAVDHVDDAYVRSVIDYLELESEKGNQAARGQLMPESDLWVVSWLGMPMYDADFGWGAPQFVAPAQMFGSGTAYVTQRADRDDGIAVLFALEPEYLQCFEEVFYGE

SEQ ID NO: 6003 - protein, 398 aa, Zea mays
MAQGAATAVDGSGSGSTARPPAALPGLKLLRRLLLVAVVGTGFLAVVVLLSSSWRYSSSMLPRVPAPDVRLPAPAGGGKVPLERWARGSASAWHNLTDEELLWAASWRPGVRRYPYRRTPKVAFMFLTRGPLPLAPLWDRFFTGAGDARLFSVYVHATPGYRPGFPPASAFYRRLVPSQVARWGEASMCDAERRLLANALLDPANERFVLLSESCVPLYGFPAVYSYLTRSRESFVGAFDDPGPHGRGRYRAGLGPEVTAGQFRKGAQWFELDRDLAVGVVADGRYYPKFRDHCRPPCYVDEHYLPTVLSIEAPARIANRSVTWVDWSPRAARTPATFGGRRTCTRRSSDGLTAPGKDQGNCTYNGQPAEVCFLFARKFAPSTLRPLLSLAPKLLGYG

SEQ ID NO: 6004 - protein, 77 aa, Setaria italica
MSPLAPSSSPEPEPPFQPREKILEKQRYFQSVHKPTYLKGRYDVITSVAIPLALAVSSMYLVGRGIYNMSHGIGKKE

SEQ ID NO: 6005 - protein, 74 aa, Triticum aestivum
MAPSYSPEPEPPFRPREKIVEKQRYFQSVHRPTYLKGRYDVITSVAIPLALAASSMFLVGRGIYNMSHGIGRKE

SEQ ID NO: 6006 - protein, 72 aa, Brachypodium distachyon
MALSSEPEPPFRPREKIVEKQRYFQSVHRPTYLKGRYDVITSVAIPLALAASSMFLVGRGIYNMAHGIGRKE

SEQ ID NO: 6007 - protein, 694 aa, Saccharum officinarum
MAALEAARSWAGSVIPPELAAAAGGDPLAALAATAAALVAGLLILAVWFRSGGGAPSKPVATTVRPPPVKVDADADVDDGRKRVTIFFGTQTGTAEGFAKSMAEEARARYEKAVFKVVDLDDYAQEDEEYEEKLKKETVVLFFLATYGDGEPTDNAARFYKWFTEGKEKEVWLKDLKYGIFGLGNRQYEHFNKVAKVVDELLEEQGGKRLVPVGLGDDDQCIEDDFTAWKELVWPELDQLLRDEDDTTGASTPYTAAIPEYRVVFIDKSDLSFQDRSWTLANGTGVIDIQHPCRANVAVRKELHKPASDRSCIHLEFDISGTGLVYETGDHVGVYAENSVETVEEAERLLDLSPDTFFSIHADAEDGSPRKGGGSLAPPFPSPCTLRTALLRYADLLNPPKKAALLALASHASDPAEAERLRFLASPAGKDEYSQWITASQRSLIEVMAAFPSAKPPLGVFFAAISPRLQPRYYSISSSPKMAPSRIHVTCALVYGPSPTGRIHQGVCSTWMKNTIPLEYSEECSWAPIFVRQSNFKLPADPSTPIIMIGPGTGLAPFRGFLQERLALKQSGAQLGTSILFFGCRNRNMDYIYEDELQTFLEEGALSELIVAFSREGPTKEYVQHKMVEKATEIWNIISHGGYLYVCGDAKGMARDVHRMLHTIVQEQGSLDSSKTESYVKSLQMEGRYLRDVW

SEQ ID NO: 6008 - protein, 694 aa, Zea mays
MAALEAAREWAGSVIPPELAAAAGGDPLAALAATAAALVAGLLIIAVWFRSGGGTPSKPVATPVRPPPVKVDADADVDDGRKRVTIFFGTQTGTAEGFAKSMAEEARARYEKAVFKVVDLDDYAQEDEEYEEKLKKETVVLFFLATYGDGEPTDNAARFYKWFTEGKEKEVWLKDLKYGIFGLGNRQYEHFNKVAKVVDELVEEQGGKRLVPVGLGDDDQCIEDDFTAWKELVWPELDQLLRDEDDTTGASTPYTAAIPEYRVVFIDKSDLSFQDRSWTLANGTGVIDIQHPCRSNVAVRKELHKPASDRSCIHLEFDISGTGLVYETGDHVGVYAENSVQTVEEVERLLDLSPDTFFSIHADAEDGSPRKGGGSLAPPFPSPCTLRTALLRYADLLNPPKKAALLALASHASDPAEAERLRFLASPSGKDEYSQWITASQRSLLEVMAAFPSAKPPLGVFFAAIAPRLQPRYYSISSSPKMAPSRIHVTCALVYGPSPTGRIHQGVCSTWMKNTIPLEYSEECSWAPIFVRQSNFKLPADPSTPIIMIGPGTGLAPFRGFLQERLALKQSGAELGTSILFFGCRNRNMDYIYEDELQTFLEEGALSELIVAFSREGPTKEYVQHKMVEKATDIWNIISNGGYLYVCGDAKGMARDVHKMLHTIVQEQGSLDNSKTESYVKSLQMEGRYLRDVW

SEQ ID NO: 6009 - protein, 694 aa, Zea mays
MAALEAVRSWAVSVIPPELAAAAGGDPLAALAATAAALVAGLLILAVWFRSGGGAPSKPVATPLRPPPVKVDADADVDDGRKRVTIFFGTQTGTAEGFAKSMADEARVRYEKAVFKVVDLDDYAQEDEEYEEKLKKETVALFFLATYGDGEPTDNAARFYKWFTEGKEKEVWLKDLKYGIFGLGNRQYEHFNKVAKVVDELLEEQGGKRLVPVGLGDDDQCIEDDFTAWKELVWPELDQLLRDEDDTNGASTPYTAAIPEYRVVFIDKSDLSFQDRSWSLANGTGVIDIHHPCRANVAVRKELHKPASDRSCIHLEFDISGTSLVYETGDHVGVYAENSVETVEEAESLLDLSPDTVFSIHADAEDGSPRKGGSSLAPPFPSPCTLRTALLRYADLLNPPKKAALLALASHASDPAEAERLRFLASPAGKDEYSQWITASQRSLLEVMAAFPSAKPPLGVFFAAIAPRLQPRYYSISSSPKMAPSRIHVTCALVYGPSPTGRIHQGVCSTWMKNTIPLEYSEECSWAPIFVRQSNFKLPADPSTPIIMIGPGTGLAPFRGFLQERLALKQSGAELGTSILFFGCRNRNMDYIYEDELQTFLEEGALSELIVAFSREGPTKEYVQHKMVEKATEIWNIISHGGYLYVCGDAKGMARDVHRMLHTVVQEQGSLDSSKTESYVKSLQMEGRYLRDVW

SEQ ID NO: 6010 - protein, 694 aa, Setaria italica
MAALEAARAWAASVIPPELAAAAGGDPLAALAATAAALVAGLLILAVWFRSGNGAPAKPAPTPVRPPPVKIDADADVDDGRKRVTIFFGTQTGTAEGFAKSMAEEARARYEKAVFKVVDLDDYAQEDEEYEEKLKKETVVLFFLATYGDGEPTDNAARFYKWFTEGKEKEVWLKDLKFGVFGLGNRQYEHFNKVAKVVDELLQEQGGKRLVPVGLGDDDQCIEDDFTAWKELVWPELDQLLRDEDDTTGASTPYTAAIPEYRVVFIDRSDLSFQDRSWTLANGTGVIDIHHPCRSNVAVRKELHKPASDRSCIHLEFDISGTGVVYETGDHVGVYSENSVETVEEAEKLLDLSPDTVFTIHADAEDGSPRRGGGSLAPPFPSPCTLRTALLRYADLLNPPKKAALLALASHASDPAEAERLRFLASPAGKDEYSQWITASQRSLLEVMAAFPSAKPPLGVFFAAIAPRLQPRYYSISSSPKMAPSRIHVTCALVYGPSPTGRIHQGVCSTWMKNTIPLEYSEECSWAPIFVRQSNFKLPADPSTPIIMIGPGTGLAPFRGFLQERLALKQSGVELGTSILFFGCRNCNVDYIYEDELQNFLQEGALSELIVAFSREGPTKEYVQHKMVEKATEIWNIISQGGYLYVCGDAKGMARDVHRVLHTIVQEQGSLDSSKTESYVKSLQMEGRYLRDVW

SEQ ID NO: 6011 - protein, 694 aa, Pennisetum glaucum
MAALEAARAWAASVIPPELAAAAGGDPLAALAATAAALVAGLVILAVWFRSGNAASAKPAPTPVRPPPVKIDADADADDGRKRVTIFFGTQTGTAEGFAKSMAEEARARYEKAVFKVVDLDDYAQEDEEYEEKLKKETVALFFLATYGDGEPTDNAARFYKWFTEGKEKEVWLKDFKYGVFGLGNRQYEHFNKVAKVVDELLLEQGGKRLVPVGLGDDDQCIEDDFNAWKELVWPELDQLLRDEDDTTGASTPYTAAIPEYRVVFIDKSDLPFQDRSWTLANGTGVIDIQHPCRSNVAVRKELHKPASDRSCIHLEFDISGTGVVYETGDHVGVYSENSVETVEEAEKLLDLSPDTFFSIHADAEDGSPRKGGGSLAPPFPSPCTLRTALLRYADLLNPPKKAALLALASHASDPAEAERLRFLASPAGKDEYSQWITASQRSLLEVMAAFPSAKPPLGVFFAAIAPRLQPRYYSISSSPKMAPSRIHVTCALVYGPSPTGRIHQGVCSTWMKNTFPLEYSEECSWAPIFVRQSNFKLPADPSTPIIMIGPGTGLAPFRGFLQERLALKQSGVELGTSILFFGCRNRNMDYIYEDELQSFLQEGALSELIVAFSREGPTKEYVQHKMVEKATEIWNIISQGGYLYVCGDAKGMARDVHRVLHTIVQEQGSFDSSKTESFVKSLQMEGRYLRDVW

SEQ ID NO: 6012 - protein, 694 aa, Panicum virgatum
MAALEAVREWAASVIPPELAAAAGGDPLAALAATAATLVAGLLILAVWFRSGGGAQAKPAPTPIRPAPVKVDADADVDDGRKRVTIFFGTQTGTAEGFAKSMAEEATARYEKAVFKVVDLDDYAQEDEEYEEKLKKETIVLFFLATYGDGEPTDNAARFYKWFTEGKEKEVWLKDLKYGVFGLGNRQYEHFNKVANVVDELLQEQGGKRLVPVGLGDDDQCIEDDFTAWKELVWPELDQLLRDEDDTTGASTPYTAAIPEYRVVFIDKSDLSFQDRSWSLANGTGVIDIHHPCRSNVAVRKELHKPASDRSCIHLEFDISGTGLVYETGDHVGVYSENSVETVEEAEKLLGLSPDTVFSIHADAEDGSPRKGGGSLAPPFPSPCTLRTALLRYADLLNPPKKAALLALASHASDPAEAERLRFLASPAGKDEYSQWITASQRSLLEVMSAFPSAKPPLGVFFAAIAPRLQPRYYSISSSPKMVPSRIHVTCALVYGPSPTGRIHQGVCSTWMKNTIPLEYSEECSWAPIFVRQSNFKLPADPSTPIIMIGPGTGLAPFRGFLQERLALKQSGVELGTSILFFGCRNRSMDYIYEDELQNFLQEGALSELIVAFSREGPTKEYVQHKMVEKATEIWNILSQGGYLYVCGDAKGMARDVHRMLHTIVQEQGSLDSSKTESYVKSLQMEGRYLRDVW

SEQ ID NO: 6013 - protein, 692 aa, Brachypodium distachyon
MALEAARSWAASVLPPELAAAAGGDPLVALAATAAALVAGLLVLAVWFRSGGGAPSKPAATPLRPPPVKVDADADADDGRKRVTIFFGTQTGTAEGFAKAMAEEAKVRYEKTVFKVVDLDDYAAEDDEYEEKLKKETLVLFFLATYGDGEPTDNAARFYKWFTEGKEKEVWLKDFKYAVFGLGNRQYEHFNKVAKVVDELLEEQGGKRLVPCGLGDDDQCIEDDFTAWKEQVWPELDQLLRDDDDTTGASTPYTAAIPEYRVVFIDKSDLVVEDKSWTLANGNGVIDIHHPCRSNVAVRKELHKPASDRSCIHLEFDISGTGLVYETGDHVGVYSENSVDTVEQAERLLGLSPDTVFSIHADAEDGSPRKGGSLAPPFPSPCTLRTALLRYADLLNSPKKAALVALASHASDPTEAERLRFLASPAGKDEYSQWIVASQRSLLEVMAAFPSAKPPLGVFFAAVAPRLQPRYYSISSSPKMAPSRIHVTCALVYGPTPTERIHQGVCSTWMKNTLPLEYSEECSWAPIFVRQSNFKLPADPSTPVIMIGPGTGLAPFRGFLQERLALKESGVGLGTSILFFGCRNRNMDYIYEDELQNFLQEGALSELVVAYSREGPTKEYVQHKMVEKATEIWNIISQGGYVYVCGDAKGMARDVHRVLHTIVQEQGSLDNSKTESYVKSLQMEGRYLRDVW

SEQ ID NO: 6014 - protein, 504 aa, Setaria italica
MNILIRLQRELLQEQGGKRLVPVGLGDDDQCIEDDFTAWKELVWPELDQLLRDEDDTTGASTPYTAAIPEYRVVFIDRSDLSFQDRSWTLANGTGVIDIHHPCRSNVAVRKELHKPASDRSCIHLEFDISGTGVVYETGDHVGVYSENSVETVEEAEKLLDLSPDTVFTIHADAEDGSPRRGGGSLAPPFPSPCTLRTALLRYADLLNPPKKAALLALASHASDPAEAERLRFLASPAGKDEYSQWITASQRSLLEVMAAFPSAKPPLGVFFAAIAPRLQPRYYSISSSPKMAPSRIHVTCALVYGPSPTGRIHQGVCSTWMKNTIPLEYSEECSWAPIFVRQSNFKLPADPSTPIIMIGPGTGLAPFRGFLQERLALKQSGVELGTSILFFGCRNCNVDYIYEDELQNFLQEGALSELIVAFSREGPTKEYVQHKMVEKATEIWNIISQGGYLYVCGDAKGMARDVHRVLHTIVQEQGSLDSSKTESYVKSLQMEGRYLRDVW

SEQ ID NO: 6015 - protein, 695 aa, Oryza sativa
MALALEAARSWAASVLPPELAAAAGGDPLAALAATAAALVAGVVILAVWFRSGGGAPPKAAAPPPRPPPVKIEADADADDGRKRVTVFFGTQTGTAEGFAKAMAEEARARYEKAVFKVVDLDDYAAEDEEYEEKLRKETIVLLFLATYGDGEPTDNAARFYKWFTEGKEKEVWLKDLKYAVFGLGNRQYEHFNKVAKVVDELLEEQGGKRLVPVGLGDDDQCIEDDFTAWKEQVWPELDQLLRDEDDTTGASTPYTAAIPEYRIVFIDKSDVSFQDKSWSLANGSGVIDIHHPVRSNVAVRKELHKPASDRSCIHLEFDISGTGLVYETGDHVGVYSENAIETVEQAEKLLDLSPDTFFSVHADAEDGSPRKGGGSLAPPFPSPCTLRTALLRYADLLNSPKKAALVALAAHASDLAEAERLRFLASPAGKDEYSQWVVASQRSLLEVMAAFPSAKPPLGVFFAAVAPRLQPRYYSISSSPKMAPSRIHVTCALVYGPTPTGRIHQGVCSTWMKNAIPSEYSEECSWAPIYVRQSNFKLPADPTTPIIMIGPGTGLAPFRGFLQERLALKQSGVELGNSVLFFGCRNRNMDYIYEDELQNFIQEGALSELIVAFSREGPAKEYVQHKMTEKATEIWNIVSQGGYIYVCGDAKGMARDVHRALHTIVQEQGSLDSSKTESYVKSLQMDGRYLRDVW

SEQ ID NO: 6016 - protein, 692 aa, Triticum aestivum
MALEAAREWAASVLPPELAAAAGGDPLAALAATAAALVAGLLVLAFWLRSGGSAPPKPPPASFRPPPVKVDADDADDGRKRVTIFFGTQTGTAEGFAKAMAEEAKARYEKVLFKVVDLDDYAAEDDEYEEKLKKETFALFFLATYGDGEPTDNAARFYKWFTEGKEKEVWLKDFNYAVFGLGNRQYEHFNKVAKEVDELLLEQGGNRLVPCGLGDDDQCIEDDFTAWKELVWPELDQLLRDEDDTTGATTPYTAAIPEYRVVFIDKSDLEFEDKSWTLANGNGVIDAQHPCRANVAVRKELHKPASDRSCIHLEFDISGTGLVYETGDHVGVYSENSIETVEQAETLLDLSPDTVFSIHADAEDGSPRKGGGSLAPPFPSPCTLRTALLRYADLLNAPKKAALTALAAHASDPTEAERLRFLASPAGKDEYAQWIVASQRSLLEVMAAFPSAKPPLGVFFAAIAPRLQPRFYSISSSPKLAPSRIHVTCALVYGPTPTERIHQGVCSTWMKNTLPLEYSEECSWAPIFVRQSNFRLPADPSTPIIMIGPGTGLAPFRGFLQERLALKESGAELGSSVLFFGCRNREMDYIYEEELQNFLQEGALSELIVAYSREGPTKEYVQHKMVDKATEIWNVISQGGYIYVCGDAKGMAKDVHRVLHTIVQKQGSLDNSKTELYVKNLQMEGRYLRDVW

SEQ ID NO: 6017 - protein, 692 aa, Secale cereale
MALEAAREWAASVLPPELAAAAGGDPLAALAATAAALLAGLLVLAFWLRSGGSAPPKPPPTSFRPPPVRVDADDADDGRKRVTIFFGTQTGTAEGFAKAMAEEAKARYEKVVFKVVDLDDYAAEDDEYEEKLKKETFALFFLATYGDGEPTDNAARFYKWFTEGKEKEVWLKDFNYAVFGLGNRQYEHFNKVAKEVDELLLEQGGKRLVPCGLGDDDQCIEDDFTAWKELVWPELDQLLRDEDDTTGATTPYTAAIPEYRVIFIDKSDLEFEDKSWTLANGNGVIDAQHPCRANVAVRKELHKPASDRSCIHLEFDISGTGLVYETGDHVGVYSENSIETVEQAETLLGLSPDTVFSIHADAEDGSPRKGGGSLAPPFPSPCTLRTALLRYADLLNVPKKAALTALAAHASDPTEAERLRFLASPAGKDEYAQWIVASQRSLLEVMAAFPSAKPPLGVFFAAIAPRLQPRFYSISSSPKLAPNRIHVTCALVYGPTPTERIHQGVCSTWMKNTLPLEYSEECSWAPIFVRQSNFRLPADPSTPIIMIGPGTGLAPFRGFLQERLALKESGVELGSSVLFFGCRNREMDYIYEEELQNFLEEGALSELIVAYSREGPTKEYVQHKMVDKATEIWNVISQGGYIYVCGDAKGMAKDVHRVLHTIVQKQGSLDNSKTELYVKNLQMEGRYLRDVW

SEQ ID NO: 6018 - protein, 691 aa, Triticum aestivum
ALEAAREWAASVLPPELAAAAGGDPLAALAATAAALVAGLLVLAFWLRSGGSAPPKPAPASFRPPPVKVDADDADDGRKRVTIFFGTQTGTAEGFAKAMAEEAKARYEKVVFKVVDLDDYAAEDDEYEEKLKKETFALFFLATYGDGEPTDNAARFYKWFTEGKEKEVWLKDFNYAVFGLGNRQYEHFNKVAKEVDELLLEQGGNRLVPCGLGDDDQCIEDDFTAWKELVWPELDQLLRDEDDTTGATTPYTAAIPEYRVIFIDKSDLEFEDKSWTLANGNGVIDAQHPCRANVAVRKELHKPASDRSCIHLEFDISGTGLVYETGDHVGVYSENSIETVEQAETLLGLSPDTVFSIHADAEDGSPRKGGGSLAPPFPSPCTLRTALLRYADLLNAPKKAALTALAAHASDPTEAERLRFLASPAGKDEYAQWIVASQRSLLEVMAAFPSAKPPLGVFFAAIAPRLQPRFYSISSSPKLAPSRIHVTCALVYGPTPTERIHQGVCSTWMKNTLPLEYSEECSWAPIFVRQSNFRLPADPSTPIIMIGPGTGLAPFRGFLQERLALKESGVELGSSVLFFGCRNREMDYIYEEELQNFLQEGALSELIVAYSREGPTKEYVQHKMVDKAIEIWSVISQGGYIYVCGDAKGMAKDVHRVLHTIVQKQGSLDNSKTELYVKNLQMEGRYLRDVW

SEQ ID NO: 6019 - protein, 689 aa, Secale cereale
EAAREWAASVLPPELAAAAGGDPLAALAATAAALLAGLLVLAFWLRSGGSAPPKPPPTSFRPPPVRVDADDADDGRKRVTIFFGTQTGTAEGFAKAMAEEAKARYEKVVFKVVDLDDYAAEDDEYEEKLKKETFALFFLATYGDGEPTDNAARFYKWFTEGKEKEVWLKDFNYAVFGLGNRQYEHFNKVAKEVDELLLEQGGKRLVPCGLGDDDQCIEDDFTAWKELVWPELDQLLRDEDDTTGATTPYTAAIPEYRVIFIDKSDLEFEDKSWTLANGNGVIDAQHPCRANVAVRKELHKPASDRSCIHLEFDISGTGLVYETGDHVGVYSENSIETVEQAETLLGLSPDTVFSIHADAEDGSPRKGGGSLAPPFPSPCTLRTALLRYADLLNVPKKAALTALAAHASDPTEAERLRFLASPAGKDEYAQWIVASQRSLLEVMAAFPSAKPPLGVFFAAIAPRLQPRFYSISSSPKLAPNRIHVTCALVYGPTPTERIHQGVCSTWMKNTLPLEYSEECSWAPIFVRQSNFRLPTDPSTPIIMIGPGTGLAPFRGFLQERLALKESGVELGSSVLFFGCRNREMDYIYEEELQNFLEEGALSELVVAYSREGPTKEYVQHKMVDKATEIWNVISQGGYIYVCGDAKGMAKDVHRVLHTIVQKQGSLDNSKTELYVKNLQMEGRYLRDVW

SEQ ID NO: 6020 - protein, 670 aa, Avena sativa
AGGDPLAALAATAAALVAGLLILAFWFRSGDGGSAKAPPAPLRPPPVKVQAEDEDDGRKRVTIFFGTQTGTAEGFAKAMAEEAKARYEKVVFRVVDLDDYAAEDEEYEEKLKKETFALFFLATYGDGEPTDNAARFYKWFTEGKEKEIWLKDFKYAVFGLGNRQYEHFNKVAKVVDDLLLEQGGKRLVPCGMGDDDQCIEDDFTAWKELVWPELDQLLRDEDDTAGASTPYTAAIPEYRVVFIDKSDLVFEDRSWTLANGNGVIDAQHPCRSNVAVRKELHKPASDRSCIHLEFDISGTGLMYETGDHVGVYSENSVETVEQAETLLGLSPDTVFSIHADAEDGSPRKGGSLAPPFPSPCSLRTALLKYADLLNSPKKAALTALAAHASDPTEAERLRFLASPAGKDEYAQWIVASQRSLIEVMAAFPSAKPPLGVFFAAVAPRLQPRFYSISSSPKMAPSRIHVTCALVYGPTPTERIHQGVCSTWMKNTLPLEYSEECSWAPIFVRQSNFKLPADPSTPIIMIGPGTGLAPFRGFLQERLALKESGVELGSSVLFFGCRNREMDYIYEDELQNFIQEGALSELVIAYSREGPTKEYVQHKMVDKATEIWNIISEGGYLYVCGDAKGMAKDVHRVLHTIVQKQGSLDNSKTELYVKNLQMEGRYLRDVW

SEQ ID NO: 6021 - protein, 692 aa, Secale cereale
DGAGGGEGVGGVRAAAGAGRGGGGHPLAALAATAAALLAGLLVLAFWLRSGGSAPPKPPPTSFRPPPVRVDADDADDGRKRVTIFFGTQTGTAEGFAKAMAEEAKARYEKVVFKVVDLDDYAAEDDEYEEKLKKETFALFFLATYGDGEPTDNAARFYKWFTEGKEKEVWLKDFNYAVFGLGNRQYEHFNKVAKEVDELLLEQGGKRLVPCGLGDDDQCIEDDFTAWKELVWPELDQLLRDEDDTTGATTPYTAAIPEYRVIFIDKSDLEFEDKSWTLANGNGVIDAQHPCRANVAVRKELHKPASDRSCIHLEFDISGTGLVYETGDHVGVYSENSIETVEQAETLLGLSPDTVFSIHADAEDGSPRKGGGSLAPPFPSPCTLRTALLRYADLLNVPKKAALTALAAHASDPTEAERLRFLASPAGKDEYAQWIVASQRSLLEVMAAFPSAKPPLGVFFAAIAPRLQPRFYSISSSPKLAPNRIHVTCALVYGPTPTERIHQGVCSTWMKNTLPLEYSEECSWAPIFVRQSNFRLPADPSTPIIMIGPGTGLAPFRGFLQERLALKESGVELGSSVLFFGCRNREMDYIYEEELQNFLQEGALSELIVAYSREGPTKEYVQHKMVDKATEIWNVISQGGYIYVCGDAKGMAKDVHRVLHTIVQKQGSLDNSKTELYVKNLQMEGRYLRDVW

SEQ ID NO: 6022 - protein, 656 aa, Triticum aestivum
LLAGLLVLAFWLRSGGSAPPKPPPASFRPPPVKVDADDADDGRKRVTIFFGTQTGTAEGFAKAMAEEAKARYEKVLFKVVDLDDYAAEDDEYEEKLKKETFALFFLATYGDGEPTDNAARFYKWFTEGKEKEVWLKDFNYAVFGLGNRQYEHFNKVAKEVDELLLEQGGKRLVPCGLGDDDQCIEDDFTAWKELVWPELDQLLRDEDDTTGATTPYTAAIPEYRVVFIDKSDLEFEDKSWTLANGNGVIDAQHPCRANVAVRKELHKPASDRSCIHLEFDISGTGLVYETGDHVGVYSENSIETVEQAETLLGLSPDTLFSIHADAEDGSPRKGGGSLAPPFPSPCTLRTALLRYADLLNAPKKAALTALAAHASDPTEAERLRFLASPAGKDEYAQWIVASQRSLLEVMAAFPSAKPPLGVFFAAIAPRLQPRFYSISSSPKLAPSRIHVTCALVYGPTPTERIHQGVCSTWMKNTLPLEYSEECSWAPIFVRQSNFRLPADPSTPIIMIGPGTGLAPFRGFLQERLALKESGVELGSSVLFFGCRNREMDYIYEEELQNFLQEGALSELIVAYSREGPTKEYVQHKMVDKATEIWNVISQGGYIYVCGDAKGMAKDVHRVLHTIVQKQGSLDNSKTELYVKNLQMEGRYLRDVW

SEQ ID NO: 6023 - protein, 630 aa, Triticum aestivum
FRPPPVKVDADDADDGRKRVTIFFGTQTGTAEGFAKAMAEEAKARYEKVVFKVVDLDDYAAEDDEYEEKLKKETFALFFLATYGDGEPTDNAARFYKWFTEGKEKEVWLKDFNYAVFGLGNRQYEHFNKVAKEVDELLLEQGGKRLVPCGLGDDDQCIEDDFTAWKELVWPELDQLLRDEDDTTGATTPYTAAIPEYRVVFIDKSDLEFEDKSWTLANGNGVIDAQHPCRANVAVRKELHKPASDRSCIHLEFDISGTGLVYETGDHVGVYSENSIETVEQAETLLGLSPDTVFSIHADAEDGSPRKGGGSLAPPFPSPCTLRTALLRYADLLNVPKKAALTALAAHASDPTEAERLRFLASPAGKDEYAQWIVASQRSLLEVMAAFPSAKPPLGVFFAAIAPRLQPRFYSISSSPKLAPSRIHVTCALVYGPTPTERIHQGVCSTWMKNTLPLEYSEECSWAPIFVRQSNFRLPADPSTPIIMIGPGTGLAPFRGFLQERLALKESGVELGSSVLFFGCRNREMDYIYEEELQNFLQEGALSELIVAYSREGPTKEYVQHKMVDKATEIWNVISQGGYIYVCGDAKGMAKDVHRVLHTIVQKQGSLDNSKTELYVKNLQMEGRYLRDVW

SEQ ID NO: 6024 - protein, 638 aa, Hordeum vulgare
RTRAAPRVLPPAARKVDADDADDGRKRVTIFFGTQTGTAEGFAKAMAEEAKARYEKAVFKVVDLDDYAAEDDEYEEKLKKETFALFFLATYGDGEPTDNAARFYKWFTEGKEKEVWLKDFNYAVFGLGNRQYEHFNKVAKEVDELLLEQGGKRLVPCGLGDDDQCIEDDFTAWKELVWPELDQLLRDEDDTTGATTPYTAAIPEYRVVFIDKSDLEFEDKSWTLANGNGVIDAQHPCRSNVAVRKELHKPASDRSCIHLEFDISGTGLVYETGDHVGVYSENSIETVEQAEALLGLSPDTLFSIHADAEDGSPRKGGGSLAPPFPSPCTLRTALLRYADLLNSPKKAALTALAAHASDPAEAERLRFLASPAGKDEYAQWIVASQRSLLEVMAAFPSAKPPLGVFFAAVAPRLQPRFYSISSSPKLAPSRIHVTCALVYGPTPTERIHQGVCSTWMKNTLPLEYSEECSWAPIFVRQSNFRLPADPSTPIIMIGPGTGLAPFRGFLQERLALKESGVELGSSVLFFGCRNRDMDYIYEDELQNFLQEGALSELIVAYSREGPTKEYVQHKMIDKATEIWNVISQGGYIYVCGDAKGMAKDVHRVLHTIVQKQGSLDNSKTELYVKNLQMEGRYLRDVW

SEQ ID NO: 6025 - protein, 582 aa, Pennisetum glaucum
AVFKVVDLDDYAQEDEEYEEKLKKETVALFFLATYGDGEPTDNAARFYKWFTEGKEKEVWLKDFKYGVFGLGNRQYEHFNKVAKVVDELLLEQGGKRLVPVGLGDDDQCIEDDFNAWKELVWPELDQLLRDEDDTTGASTPYTAAIPEYRVVFIDKSDLPFQDRSWTLANGTGVIDIQHPCRSNVAVRKELHKPASDRSCIHLEFDISGTGVVYETGDHVGVYSENSVETVEEAEKLLDLSPDTFFSIHADAEDGSPRKGGGSLAPPFPSPCTLRTALLRYADLLNPPKKAALLALASHASDPAEAERLRFLASPAGKDEYSQWITASQRSLLEVMAAFPSAKPPLGVFFAAIAPRLQPRYYSISSSPKMAPSRIHVTCALVYGPSPTGRIHQGVCSTWMKNTFPLEYSEECSWAPIFVRQSNFKLPADPSTPIIMIGPGTGLAPFRGFLQERLALKQSGVELGTSILFFGCRNRNMDYIYEDELQSFLQEGALSELIVAFSREGPTKEYVQHKMVEKATEIWNIISQGGYLYVCGDAKGMARDVHRVLHTIVQEQGSFDSSKTESFVKSLQMEGRYLRDVW

SEQ ID NO: 6026 - protein, 651 aa, Solanum tuberosum
MAVTTFFSLSLLIITAALQVAGQTTPVAEAPAPAADDCNGIFLQYVFTSGSKIKPTLKARQPYKFQSILSITNNGLDELKLWRVFVGFQHDEILVSASNAVLDDGESFPALVGNGTVFAGFPAADLKTAVETAGDTTQTTAQIKIVGTQFGVGSPNVPMPSNISLENDGFICPKPSMQGKSVMQVCCIKDEKFKTNLTLGEKFSPRQDGDLTIMYDILRTYDSNYWAQVTIANHNPLGRLDNWKLSWDWMKDEFIWEMKGAYPSVVDTSECVFGPQAKFYQNLDFSTGLNCQRRPTLIDLPLEKTNDTKLGMIPFCCRNGTILPPAMDPSKSVSAFQMNVFKMPPDLNRSSFTPPQNWKIEGRLNPDYKCGPPVRVSPTQVPDPSGLLPATSVFASWQVVCNITQPKGASPRCCVSFSAFYNESIIPCPTCACGCPSNTARTCSMKAPALLLPSQALLVPFDNRTKMSLAWADINHLPVSNPLPCGDNCGVSINWHLFTDYRGGWSARITIFNWEDAAFADWFTAVELDKAAAGFDAVYSFNGTMLDGVNNTIFMQGLPGLNYIVAEADGANPEKDPRVPGKQQSVISFTKKNIPNINIAAGDGFPTKLYFNGEECSLPKVLPTSSSSRISSFTVTTSILAAVVVFMLVRQ

SEQ ID NO: 6027 - protein, 651 aa, Solanum phureja
MAVTTFFSLCLLIITAALQVAGQTTPVAEAPAPAADDCNGIFLQYVFTSGSKIKPTLKARQPYKFQSILSITNNGLDELKLWRVFVGFQHDEILVSASNAVLDDGESFPALVGNGTVFAGFPAADLKTAIETAGDTTQTTAQIKIVGTQFGVGSPNVPMPSNISLENDGFICPKPSMQGKSVMQVCCIKDEKFKTNLTLGEKFSPRQDGDLTIMYDILRTYDSNYWAQVTIANHNPLGRLDNWKLSWDWMKDEFIWEMKGAYPSVVDTSECVFGPQAKFYQNLDFSTGLNCQRRPTLIDLPLEKTNDTKLGMIPFCCRNGTILPPAMDPSKSVSAFQMNVFKMPPDLNRSSFTPPQNWKIEGRLNPDYKCGPPVRVSPTQVPDPSGLLPATSVFASWQVVCNITQPKGASPRCCVSFSAFYNESIIPCPTCACGCPSNTGRTCSTKAPALLLPSQALLVPFDNRTKMSLAWADINHLPVSNPLPCGDNCGVSINWHLFTDYRGGWSARITIFNWEDAAFADWFTAVELDKAAAGFDAVYSFNGTMLDGVNNTIFMQGLPGLNYIVAEADGANPEKDPRVPGKQQSVISFTKKNIPNINIAAGDGFPTKLYFNGEECSLPKVLPTSSSSRISSFTVTTSILAAVVVFMLVRQ

SEQ ID NO: 6028 - protein, 505 aa, Triticum aestivum
MAAGTGRVLPLLAVAAALAAALLYTAPFSKSLGGEGCSLLPHGHFWIASQRVVALGRVGPAAVEVKEGLINAIAVGDYRSFVLRRPLVDYGDAVIMPGLIDVHAHLDEPGREEWEGFSTGTRAAAAGGITTLVDMPLNSFPSTVSEETLKLKVDAARDKLYVDVGFWGGLVPENALNPSKLESLLNAGVLGLKSFMCPSGINDFPMTNSSHIEEGLVTLAKYKRPLLIHAERIPDVSSDEELDGELDPRSYATYLKSRTPAWEESAVRDLKRAMKDTEVGGRSEGAHLHIVHLSDSKTTLDLLKDAKHSGAKVTIETCPHYLAFSAEEVPDGDTRFKCSPPIRDAANKEDLWEALLDGHIDMLSSDHSPSTPDLKLMEEGNFMKAWGGISSLQFVLPVTWSHGKKYGITLNQLASWWSEKPAELAGQKNKGSILPGYHADIVVWKPEAQFHLDDTHAVYHKHRNISAYLGKELSGKVLSTFVRGNLVFAEGKHAGAACGATILAK

SEQ ID NO: 6029 - protein, 510 aa, Brachypodium distachyon
MAAAAAAAGKGRALPLLAVAAALAAALLYRAPFSKSLGGEGCSLLPQDHFWIASERVVTLGRVGPAAVEVKGGLINAIAVGDYRSFVLRRPLLDYGDAVIMPGLIDVHAHLDEPGRAEWEGFSTGTRAAAAGGITTLVDMPLNSFPSTVSEETLKLKVEASRDKLYVDVGFWGGLVPENALNPSKLESLLNAGVLGLKSFMCPSGINDFPMTNSTHIEEGLVTLAKYKRPLLIHAERIPDVESDEGIDGELDPRSYSTYLKSRPPIWEESAIRDLQRAMKDTKVGGRSEGAHIHIVHLSDAETSLQLLKDAKHNGARVSIETCPHYLAFSAEEVPDGDTRFKCSPPIRHAANKDNLWEALLDGHIDMLSSDHSPSTPDLKLMEDGNFLKAWGGISSLQFVLPVTWSYGKKHGITLNQLASWWSEKPAMLAGQKNKGSILPGYHADIVVWKPEAEFQLDNSHAVYHKHRNISAYLGKELSGKVLSTFVRGNLVFAEGKHAGAACGATILAK

SEQ ID NO: 6030 - protein, 314 aa, Oryza sativa
MAAAKGRVLPLLAVAAALAAALLYRAPFSKSLGGEGCSLLPHDHFWIASERVVTLGRVGPAAVEVKGGLINAIAVGDYRSFLLRRPVVDYGDAVIMPGLIDVHAHLDEPGRAEWEGFSTGTRAAAAGGITTLVDMPLNSYPSTVSEETLKLKLDAAKDKLHVDVGFWGGLVPENALNPSALESLLNAGVLGLKSFMCPSGINDFPMTNSTHIEEGLVTLAKYKRPLLIHAERIPDVQNEDGIDGELDPKAYTTYLKSRPPAWEEAAIKDLQRAMKDTEIGGRSEGAHIHIVHLSDAKLLLGFLRMQNKMVQGLV

SEQ ID NO: 6031 - protein, 505 aa, Oryza sativa
MAAAKGRVLPLLAVAAALAAALLYRAPFSKSLGGEGCSLLPHDHFWIASERVVTLGRVGPAAVEVKGGLINAIAVGDYRSFLLRRPVVDYGDAVIMPGLIDVHAHLDEPGRAEWEGFSTGTRAAAAGGITTLVDMPLNSYPSTVSEETLKLKLDAAKDKLHVDVGFWGGLVPENALNPSALESLLNAGVLGLKSFMCPSGINDFPMTNSTHIEEGLVTLAKYKRPLLIHAERIPDVQNEDGIDGELDPKAYTTYLKSRPPAWEEAAIKDLQRAMKDTEIGGRSEGAHIHIVHLSDAKTSLGLLKDAKQNGARVSVETCPHYLAFSAEEVPDGDTRFKCAPPIRDSTNRDNLWEALLDGHIDMLSSDHSPSAPDLKLMEEGNFLRAWGGISSLQFVLPVTWSHGKKYGISLNQLASWWSERPAMLAGLKKKGAVLPGYRADIVVWKPEAQFHLDDSHPVYHKHRNISAYLGKQLSGKILSTFVGGNLVFAEDKHAKAACGAPILAK

SEQ ID NO: 6032 - protein, 532 aa, Secale cereale
MAAAAGVWQLVGAAAATLLAAVLVAAALGRQRQRRRRRAPVEGIPAPEDGCAVADGAGSAAVDGPTDVIIVGAGVAGSALAYTLGKDGRRVHVIERDLTEPDRIVGELLQPGGYLKLMELGLQDCVDEIDAQRVLGYALFKDGKNTKLSYPLEKFHSDVAGRSFHNGRFIQRMREKAASLPNVQLEQGTVTSLLEENGTVKGVQYKVKSGEEQKAYAPLTIVCDGCFSNLRRALCSPKVEVPSCFVGLVLENCELPHANHGHVILANPSPILFYPISSTEVRCLVDVPGQKVPSIASGEMANYLKTVVAPQIPPQIYDSFIAAIDKGSIRTMPNRSMPAAPHPTPGALLMGDAFNMRHPLTGGGMTVALSDIVVLRNLLKPLRNLHDASALCKYLESFYTLRKPVASTINTLAGALYKVFSSSPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 6033 - protein, 532 aa, Secale cereale
MAAAAGVWQLVGAAAATLLAAALVAVALGRQRQRRRRRAPVEGIPAPVDGCAVADGAGSAAVDGPTDVIIVGAGVAGSALAYTLGKDGRRVHVIERDLTEPDRIVGELLQPGGYLKLMELGLQDCVDEIDAQRVLGYALFKDGKNTKLSYPLEKFHSDVAGRSFHNGRFIQRMREKAASLPNVQLEQGTVTSLLEENGTVKGVQYKIKSGEELKAYAPLTIVCDGCFSNLRRALCSPKVEVPSCFVGLVLENCELPHANHGHVILANPSPILFYPISSTEVRCLVDVPGQKVPSIASGEMANYLKTVVAPQIPPQIYDSFIAAIDKGSIRTMPNRSMPAAPHPTPGALLMGDAFNMRHPLTGGGMTVALSDIVVLRNLLKPLRNLHDASALCKYLESFYTLRKPVASTINTLAGALYKVFSSSPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 6034 - protein, 533 aa, Avena sativa
MAEVAAVGQLGGAATAATLLAALFLAVLFRHQRRRRQRGAPVEGIPAPVDRCAVADGEGIAALDGPTDVIIVGAGVAGSALAYTLGKDGRRVHVIERDLTEPDRIVGELLQPGGYLKLVELGLQDCVDEIDAQRVLGYALFKDGKNTKLSYPLEKFHSDVAGRSFHNGRFIQRMREKAASLPNVQLEQGTVTSLLEENGTVKGVQYKNKSGEELKAHAPLTIVCDGCFSNLRRALCSPKVESPSCFVGLVLENCELPHRNHGHVILANPSPILFYPISSTEVRCLVDVPGQKVPSIASGEMANYLKTVVAPQIPPEIYDSFVAAIDKGSIRTMPNRSMAAAPHPTPGALLMGDAFNMRHPLTGGGMTVALSDIVVLRNLLKPLRNLHDASSLCKYLESFYTLRKPVASTINTLAGALYKVFSASPDKARDEMRQACFDYLSLGGVCSNGPIALLSGLNPRPLSLVAHFFAVAIFGVGRLMLPLPSPKRMWIGARLISGACGIIFPIIKAEGVRQMFFPATVPAYYRAPPEAEF

SEQ ID NO: 6035 - protein, 529 aa, Brachypodium distachyon
MAAAAGFGPLVGAAAATLLAAVFLAAVLGRRRRRRAPVEGSTAPGGGCAVADGEGHAAEDGTTDVIIVGAGVAGSALAYTLGKDGRRVHVIERDLTEPDRIVGELLQPGGYLRLMELGLQDCVDEIDAQRVLGYALFKDGKNTKLSYPLEKFHSDVAGRSFHNGRFIQRMRQKAASLPNVQLEQGTVTSLIEENGTVKGVQYKIKSGEEQKAYAPLTIVCDGCFSNLRRALCSPKVEVPSCFVGLVLENCQLPHANHGHVILANPSPILFYPISSTEVRCLVDVPGQKVPSIASGDMANYLKTVVAPQIPPEIYDSFVAAIDKGSIRTMPNRSMPAAPHPTPGALLMGDAFNMRHPLTGGGMTVALSDIVVLRNLLKPLRNLHDASSLCKYLESFYTLRKPVASTINTLAGALYKVFSSSPDKARDEMRQACFDYLSLGGVCSNGPIALLSGLNPRPLSLVAHFFAVAIYGVGRLMLPVPSPKRMWIGARLISGACGIIFPIIKAEGVRQMFFPATVPAYYRAPPEAEF

SEQ ID NO: 6036 - protein, 534 aa, Panicum virgatum
MAAVAAGAGVGLQLIGAAAATLLAAVLVAAVLGRRRRPLARAPLVEGKPAPEDGCAVGDGKGAAGDGGTDVIIVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTVKGVQYKTKSGEELKAFAPLTIVCDGCFSNLRRALCSPKVDVPSCFVGLVLENCQLPHPNHGHVILANPSPILFYPISSTEVRCLVDVPGQKVPSIASGEMANYLKTVVAPQIPPEIYDSFIAAIDKGSIRTMPNRSMPAAPHPTPGALLMGDAFNMRHPLTGGGMTVALSDIVVLRNLLKPLRNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAFYRAAPAAE

SEQ ID NO: 6037 - protein, 534 aa, Panicum virgatum
MAAVAAGAGVGLQLIGAAAATLLVAVLVAAVLGRRRRPPARAPLVEGKPAPEDGRAVGDGEGAAGDGGTDVIIVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTVKGVQYKTKSGEELKAFAPLTIVCDGCFSNLRRALCSPKVDVPSCFVGLVLENCQLPHPNHGHVILANPSPILFYPISSTEVRCLVDVPGQKVPSIANGEMANYLKTVVAPQIPPEIYDSFIAAIDKGSIRTMPNRSMPAAPHPTPGALLMGDAFNMRHPLTGGGMTVALSDIVVLRNLLKPLRNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPSAE

SEQ ID NO: 6038 - protein, 534 aa, Zea mays
MAAMAAAGGVGLHLIGAATATLIAAVLVAAVLGRRRRARARAQAPPVEGKPAPEAGCAVGDGAGPDGGTDVIIVGAGVAGSALAYTLGKDGRRVHVIERDLTEPDRIVGELLQPGGYLKLIELGLQDCVEEIDAQRVLGYALFKDGRNTKLAYPLEKFHSDVAGRSFHNGRFIQRMRQKAASLPNVQLEQGTVTSLLEENGTVKGVQYKTKSGEELKAYAPLTIVCDGCFSNLRRALCSPKVDVPSCFIGLVLENCQLPHPNHGHVILANPSPILFYPISSTEVRCLVDVPGQKVPSIASGEMANYLKTVVAPQIPPEIYDSFIAAIDKGSIRTMPNRSMPAAPLPTPGALLMGDAFNMRHPLTGGGMTVALSDIVVLRNLLKPLRNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPTGE

SEQ ID NO: 6039 - protein, 529 aa, Saccharum officinarum
MAAAAAAAGVGFQLIGAAAATFLAAVLVAAVLGRRRRPRPRPQAPLVEGKPAPEAGCAVGDGGTDVIIVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTIKGVQYKTKSGEELKAYAPLTIVCDGCFSNLRRALCSPKVDVPSCFVGLVLENCQLPHPNHGHVILANPSPILFYPISSTEVRCLVDVPGQKVPSIASGEMANYLKTVVAPQIPPEIYDSFIAAIDKGSIRTMPNRSMPAAPHPTPGALLMGDAFNMRHPLTGGGMTVALSDIVVLRNLLKPLRNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYQAAPMGE

SEQ ID NO: 6040 - protein, 529 aa, Sorghum bicolor
MAAAAAAASGVGFQLIGAAAATLLAAVLVAAVLGRRRRRARPQAPLVEAKPAPEGGCAVGDGRTDVIIVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTVKGVQYKTKSGEELKAYAPLTIVCDGCFSNLRRALCSPKVDVPSCFVGLVLENCQLPHPNHGHVILANPSPILFYPISSTEVRCLVDVPGQKVPSIASGEMANYLKTVVAPQIPPEIYDSFIAAIDKGSIRTMPNRSMPAAPHPTPGALLMGDAFNMRHPLTGGGMTVALSDIVVLRNLLKPLHNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPMGE

SEQ ID NO: 6041 - protein, 534 aa, Setaria italica
MAAAAAAAGAGLQLIGAAAATLLAAVLVAAVLGRRRGSGPRSPLVEEKAAAEAACATGDGAGAAGDGGSDVIIVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTVKGVQYKTKSGQELKAYAPLTIVCDGCFSNLRRALCSPKVDVPSCFVGLVLENCQLPHPNHGHVILANPSPILFYPISSTEVRCLVDVPGQKVPSIASGEMANYLKTVVAPQIPPEIYESFIAAIDKGSIRTMPNRSMPAAPHPTPGALLMGDAFNMRHPLTGGGMTVALSDIVVLRNLLKPLRNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPTVE

SEQ ID NO: 6042 - protein, 530 aa, Oryza sativa
MAEVAAGTGQLIGVAVATLLAAIFLAAALLGSRRRRRRAPLAGKPAAVGGCGVADGEGCGGDGRTDVIVVGAGVAGSALAYTLGKDGRRVHVIERDLTEPDRIVGELLQPGGYLKLIELGLEDCVQEIDAQRVLGYALFKDGKDTKLSYPLEKFHSDVAGRSFHNGRFIQRMRQKAASLPNVQLEQGTVTSLVEEDGTVKGVKYKTKSGEELKAYAPLTIVCDGCFSNLRRALCSPKVDVPSCFVGLVLENCQLPHANHGHVVLANPSPILFYPISSTEVRCLVDVPGQKVPSIANGEMAKYLKTVVAPQIPPEIYDSFIAAIDKGSIRTMPNRSMPAAPHPTPGALLMGDAFNMRHPLTGGGMTVALSDIVVLRNLLKPLRNLHDASALCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGVRLISSACGIIFPIIKAEGVRHMFFPATVPAYYRAPRPME

SEQ ID NO: 6043 - protein, 525 aa, Pennisetum glaucum
AAGAGAGLQLIGAAAATLLAVVLVAAVLGRRRRSGPRSTLVQEKAAAEAACADAAGDGGTDVIVVGAGVAGSALAYTLGKDGRRVHVIERDLTEPDRIVGELLQPGGYLKLIELGLEDCVEEIDAQRVLGYALFKDGRNTKLAYPLEKFHSDVAGRSFHNGRFIQRMRQKAASLPNVQLEQGTVTSLLEENGTVKGVQYKTKSGEERKAYAPLTIVCDGCFSNLRRALCSPKVDVPSCFVGLVLENCQLPHPNHGHVILANPSPILFYPISSTEVRCLVDVPGQKVPSIASGEMANYLKTVVAPQIPPEIYDSFIAAIDKGSIRTMPNRSMPAAPHPTPGALLMGDAFNMRHPLTGGGMTVALSDIVVLRNLLKPLRNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPNVE

SEQ ID NO: 6044 - protein, 529 aa, Zea mays
MAATAAAAGVEFPLIGVAVATLIVTVLVAAVMRRRRRPWHQAPLVEGKPAPEAGCAVSDGGTDVIIVGAGVAGSALAYTLGKDGRRVHVIERDLTEPDRIVGELLQPGGYLKLIELGLQDCVEEIDAQRVLGYALFKDGRNTKLAYPLEKFHSDVAGRSFHNGRFIQRMRQKAASLPNVQLEQGTVTSLLEENGTVKGVQYKTKSGEELKAYAPLTIVCDGCFSNLRRALCSPKVDVPSCFVGLVLENCQLPHPNHGHVILANPSPILFYPISSTEVRCLVDVPGQKVPSIATGEMANYLKTVVAPQIPPEIYDSFIAAIDKGSIRTMPNRSMPAAPHPTPGALLMGDAFNMRHPLTGGGMTVALSDIVVLRNLLKPLRNLHDASSLCKYLESFYTLRKPVASTINTLAGALYKVFSASPDQARNEMRQACFDYLSLGGVFSNGPIALLSGLNPRPLSLVAHFFAVAIYGVGRLMLPLPSPKRMWIGARLISGACGIILPIIKAEGVRQMFFPATVPAYYRAAPTGEKA

SEQ ID NO: 6045 - protein, 524 aa, Oryza sativa
MDAVAGAGQLVGLAAATLLTAAFLVAVKMGWRRRRRQREVAPEGGCRVVGGDGGDRTDIVIVGAGVAGSALAYTLGKDGRRVHVIERDMTEPDRIVGELLQPGGYLKLMELGLEDCVEEIDAQRVLGYALLKDGRNTKLSYPLEKFHSDVAGRSFHNGRFIQKMRQKAASLPNVHLEQGTVTSLLEEGGTVKGVQYKTKSGEELKAYAPLTIVCDGCFSNLRRVLCSPKVDVPSCFVGLVLENCQLPHPNHGHVILANPSPILCYPISSTEIRCLVDIPGQKVPSMATGEMAKYLKTVVAPQIPPELHDSFIAAIDKGSIRTMPNRSMPAAPLPTPGALLMGDAFNMRHPLTGGGMTVAFSDIVVLRNLLKPLGNLHDAPSLCKYLESFYTLRKPVASTINTLAGALYKVFCASTDQAKNEMREACFDYLSLGGVFSNGPIALLSGLNPRPLSLVAHFFAVAIYGVGRLMLPVPSPKRMWIGARLVSGACGIIFPIIKAEGVRQMFFPATVPAYYRAPPPMESG

SEQ ID NO: 6046 - protein, 626 aa, Hordeum vulgare
MAERAISLSPPPPIKNGTISNSKRPPLPRLSSPPPPRPKSQSHRLALSRPAPFRPRTHHPRPKNPHANPTNAAPRREIPKAQGTAAPAGAGPHCGMAAAAGVWQLVGAAAATLLAAVLVAVALGRQRQRRRGAPAQGVPAPEDGCAVADGQGSAAVDGPTDVIIVGAGVAGSALAYTLGKDGRRVHVIERDLTEPDRIVGELLQPGGYLKLMELGLQDCVDEIDAQRVLGYALFKDGKNTKLSYPLEKFHSDVAGRSFHNGRFIQRMREKAASLPNVQLEQGTVTSLLEENGTVKGVQYKIKSGEELKAYAPLTIVCDGCFSNLRRALCSPKVEVPSCFVGLVLENCQLPHANHGHVILANPSPILFYPISSTEVRCLVDVPGQKVPSIASGEMANYLKTVVAPQIPPEIYDSFIAAIDKGSIRTMPNRSMPAAPHPTPGALLMGDAFNMRHPLTGGGMTVALSDIVVLRNLLKPLRNLHDASALCKYLESFYTLRKPVASTINTLAGALYKVFSASPDKARDEMRQACFDYLSLGGVCSNGPIALLSGLNPRPLSLVAHFFAVAIFGVGRLMLPLPSPKRMWTGARLISGACGIIFPIIKAEGVRQMFFPATVPAYYRAPPEAEF

SEQ ID NO: 6047 - protein, 520 aa, Elaeis guineensis
MQDEYLVGGIVGAILGLLLLVGIRGRRRRGDGNLAGAAAAGGKVECGSESAGNGGADVIVVGAGVAGSALAFTLGKDARRVHVIERDLTEPDRIVGELLQPGGYLKLIELGLEDCVKEIDAQRVLGYALYKDGKNTRLPYPLEKFHSDVAGRSFHNGRFIQRMREKAASLPNVQLEQGTVTSLLEENGMVKGVSYKTKSGEELKAYAPLTIVCDGCFSNLRRSLCSPKVEVPSCFVGLVLENCQLPHPNHGHVILADPSPILFYPISSTEVRCLVDVPGQKVPSIANGEMTNYLKTVVAPQLPVELHDAFISAIDKGSIRTMPNRSMPAAPLPTPGALLMGDAFNMRHPLTGGGMTVALSDIVVLRNLLKPLRNLHDATSLCKYLESFYTLRKPVASTINTLAGALYKVFSASPDQARNEMRQACFDYLSLGGVCTNGPIALLSGLNPRPLSLVAHFFAVAIYGVGRLLLPFPSPKRLWVGARLISGASGIIFPIIRAEGVRQMFFPAMVPAYYRAPPMK

SEQ ID NO: 6048 - DNA, 666 bp, 35S_pqfnc Promoter
gcatgcctgcaggtcaattctcatgtttgacagcttatcatcggtgcgatgccccccatcgtaggtgaaggtggaaattaatgatccatcttgagaccacaggcccacaacagctaccagtttcctcaagggtccaccaaaaacgtaagcgcttacgtacatggtcgataagaaaaggcaatttgtagatgttaacatccaacgtcgctttcagggatcccccctcagaagaccagagggctattgagacttttcaacaaagggtaatatcgggaaacctcctcggattccattgcccagctatctgtcacttcatcgaaaggacagtagaaaaggaaggtggctcctacaaatgccatcattgcgataaaggaaaggctatcgttcaagatgcctctaccgacagtggtcccaaagatggacccccacccacgaggaacatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacaggcttcttgagatccttcaacaattaccaacaacaacaaacaacaaacaacattacaattactatttacaattaca

SEQ ID NO: 6049 - DNA, 781 bp, 35S_pJJ Promoter
tcgacctgcagccaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgctagagcagcttgagcttggatcagattgtcgtttcccgccttcagtttagcttcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactcttgaccatgg

SEQ ID NO: 6050 - DNA, 877 bp, 35S (OLD) Promoter
aagcttgcatgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggactctagaggatcc

SEQ ID NO: 6051 - DNA, 2322 bp, AT 6669 (OLD) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctgattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcagacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctacctccttttgcattcttaactttatcttctctacttatttcttttttgggatttttgggggtattattttatcttttgtagatatacacattgatttactacaaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaaaactaaaaaagagaaccccaaaggatcc

SEQ ID NO: 6052 - DNA, 2318 bp, AT 6669 (NEW) Promoter
aagctttaagctccaagcccacatctatgcacttcaacatatctttttctagatgagttggtaaaagtagaaaaagatatgatgattttaaatttgtttctatttatatgtgttcatcgaaacttcattttttttagttttaatagagagtttatatgacttttaaaaattgatttaaaactgtgtcaaaaattaaaaggacaataaaaaatttgcatacaaccgaaaatacttatatttagacaagaaaaaataatacttgtgatgctaattttattttattatatatcatgaatcatgatcatccaattttccggataagccaaagtcaaaatgatgggttccccctaatcttttatgctgagaaatagatgtatattcttagatagtaatataaaattgggttaaagaatgatgattcgattatagcctcaactagaagatacgtgtagtgcaggtgtgtagttaactggtggtagtggcggacaaccagattaggagttaaataaagcctttagatttgagagattgaaatattcgattggaacctttctagatttttacagccatctaaaattagatgcagatcacctactaccattcaaaaatgaacaaaataatttcatttacattttcctagcataagatataataataaaatagtgctcattttaattactttttctaaatattttcgttattttaaattttgcttgtctatactctacagctcatttaataacggaaacaaaaataattgcagggatacggatgggtagctttcaaaacttacatcatcttctgtttcttgagatcaactatttttggagctttgtctcaatcgtaccaaaggataatggtcctactcccttttgcattcttaactttatcttctctacttatttcttttttgggatttttgggggtattattttatcttttgtagatatacacattgatttactataaacgtatactactatccatcttcaactcttcggaatatgatttcgaaaaaactatgaagattaacgggtatcttaaacatgttaagatacaccggacaattttcatttagaagaattgatatgcaattaacaataaatagttgatgatcttttagttttgaagatgtgcgttaagacttaagcgtgtggtaacaaggtgggactcgggcaacgcaaagccttgtagagtccacttgctcaacttgtctttcttttatctcttttccaagtctcaagattcaatgaactccgtgtaacacaaacacgcccatagatgagctcatttttggtatttccaatattgccactccatgataatatcatctagggatggggttcatttattttgaaatctcaacaaatctcgtcgattctaacacacatgattgatttgtttacttacttgaaagttggcaactatctgggattaaaatttatctttttctactgctagctagaagcatctatatatgttagcctaatacgtggaagatgtcattgctaataatggctaaagatgtgtattaatttttcttcttttttccttgaatttttgttctttgacataaactatgctgtcaaaatgtgtagaatctttttacataaatcattccctgttacacactaaaaggttcacaacggacgattgtattggacttccagatcataaaccatgcaaaactgaaaaccacaagaataattagttctaactttagaacgttcgtacgtgtttcatgttcaaaaagcgtcaattataaaagttgggaaattacttttgagttttgacatttctaaggacagtcaaatatgacaacattgggatgcaacttaccttgtattaacttattttgttataaaaccatatattacatattttaaagggttgataaataatcaaatataccaaaacatagcttttcaatatatttgtaaaacacgtttggtctactagctaattatgagaacatttgttcaatgcatgattatctagtatctactagtggattatgaaaattagatattttcattgcatgattatcttccatatatagtgataacatcaaaagaatctacaccaattattgcattttttcattatataataagcactaaactgtaaaattatattcagccacccaaaccatgacaaatcaccttaaaggcttaaacacataacagccattacgagtcacaggtaagggtataatagtaaagaatcaatctatataatatacgacccaccctttctcattctttctggagagtaacatcgagacaaagaagaaagactaaaaaagagaaccccaaaga

SEQ ID NO: 6053 - DNA, 1992 bp, Maize Ubi 1 Promoter
tctgcagtgcagcgtgacccggtcgtgcccctctctagagataatgagcattgcatgcctaagttataaaaaattaccacatattttttttgtcacacttgtttgaagtgcagtttatctatctttatacatatatttaaactttactctacgaataatataatctatagtactacaataatatcagtgttttagagaatcatataaatgaacagttagacatggtctaaaggacaattgagtattttgacaacaggactctacagttttatctttttagtgtgcatgtgttctcctttttttttgcaaatagcttcacctatataatacttcatccattttattagtacatccatttagggtttagggttaatggtttttatagactaatttttttagtacatctattttattctattttagcctctaaattaagaaaactaaaactctattttagtttttttatttaataatttagatataaaatagaataaaataaagtgaccaaaaattaaacaaataccctttaagaaattaaaaaaactaaggaaacatttttcttgtttcgagtagataatgccagcctgttaaacgccgtcgacgagtctaacggacaccaaccagcgaaccagcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgaggcggcacggcaggcggcctcctcctcctctcacggcacggcagcctacgggggattcctttcccaccgctccttcgctttcccttcctcgcccgccgtaataaatagacaccccctccacaccctctttccccaacctcgtgttcgttcggagcgcacacacacacaaccagatctcccccaaatccacccgtcggcacctccgcttcaaggtacgccgctcatcctccccccccccctctctctaccttctctagatcggcgttccggtccatggttagggcccggtagttctacttctgttcatgtttgtgttagatccgtgtttgtgttagatccgtgctgctagcgttcgtacacggatgcgacctgtacatcagacatgttctgattgctaacttgccagtgtttctctttgaggaatcctgggatggctctagccgttccgcagacgggatcgatttcatgatttttttttgtttcgttgcatagggtttggtttgcccttttcctttatttcaatatatgccgtgcacttgtttgtcgggtcatcttttcatgttttttttggcttggttgtgatgatgtggtctggttgggcggtcgttctagatcggagtagaatactgtttcaaactacctggtggatttattaaagatctgtatgtatgtgccatacatcttcatagttacgagtttaagatgatggatggaaatatcgatctaggataggtatacatgttgatgcgggttttactgatgcatatacagagatgctttttttttcgcttggttgtgatgatgtggtctggttgggcggtcgttctagatcggagtagaatactgtttcaaactaactggtggatttattaattttggatctgtatgtgtgtgccatacatcttcatagttacgagtttaagatgatggatggaagtatcgatctaggataggtatacatgttgatgttggttttactgatgcatatacatgatggcatatgcagcatctattcattcatatgctctaaccttgagtacctatctattataataaacaagtatgttttataattattttgatcttgatatacttggatgatggcatatgcagcagctatatgtggattttttttagctctgccttcatacgctatttatttgcttggtactgtttcttttgtcgatgctcaccctgttgtttggtgttacttctgcag

SEQ ID NO: 6054 - DNA, 1266 bp, Rice Actin Promoter
tagctagcatactcgaggtcattcatatgcttgagaagagagtcgggatagtccaaaataaaacaaaggtaagattacctggtcaaaagtgaaaacatcagttaaaaggtggtataagtaaaatatcggtaataaaaggtggcccaaagtgaaatttactcttttctactattataaaaattgaggatgttttgtcggtactttgatacgtcatttttgtatgaattggtttttaagtttattcgcgatttggaaatgcatatctgtatttgagtcggtttttaagttcgttgcttttgtaaatacagagggatttgtataagaaatatctttaaaaaacccatatgctaatttgacataatttttgagaaaaatatatattcaggcgaattccacaatgaacaataataagattaaaatagcttgcccccgttgcagcgatgggtattttttctagtaaaataaaagataaacttagactcaaaacatttacaaaaacaacccctaaagtcctaaagcccaaagtgctatgcacgatccatagcaagcccagcccaacccaacccaacccaacccaccccagtgcagccaactggcaaatagtctccacccccggcactatcaccgtgagttgtccgcaccaccgcacgtctcgcagccaaaaaaaaaaaaagaaagaaaaaaaagaaaaagaaaaacagcaggtgggtccgggtcgtgggggccggaaaagcgaggaggatcgcgagcagcgacgaggcccggccctccctccgcttccaaagaaacgccccccatcgccactatatacatacccccccctctcctcccatccccccaaccctaccaccaccaccaccaccacctcctcccccctcgctgccggacgacgagctcctcccccctccccctccgccgccgccggtaaccaccccgcccctctcctctttctttctccgttttttttttcgtctcggtctcgatctttggccttggtagtttgggtgggcgagagcggcttcgtcgcccagatcggtgcgcgggaggggcgggatctcgcggctggcgtctccgggcgtgagtcggcccggatcctcgcggggaatggggctctcggatgtagatcttctttctttcttctttttgtggtagaatttgaatccctcagcattgttcatcggtagtttttcttttcatgatttgtgacaaatgcagcctcgtgcggagcttttttgtaggtagaagatggctgacgccgaggatatc

SEQ ID NO: 6055 - DNA, 2199 bp, GOS2 Promoter
tctagaatccgaaaagtttctgcaccgttttcaccccctaactaacaatatagggaacgtgtgctaaatataaaatgagaccttatatatgtagcgctgataactagaactatgcaagaaaaactcatccacctactttagtggcaatcgggctaaataaaaaagagtcgctacactagtttcgttttccttagtaattaagtgggaaaatgaaatcattattgcttagaatatacgttcacatctctgtcatgaagttaaattattcgaggtagccataattgtcatcaaactcttcttgaataaaaaaatctttctagctgaactcaatgggtaaagagagagattttttttaaaaaaatagaatgaagatattctgaacgtattggcaaagatttaaacatataattatataattttatagtttgtgcattcgtcatatcgcacatcattaaggacatgtcttactccatcccaatttttatttagtaattaaagacaattgacttatttttattatttatcttttttcgattagatgcaaggtacttacgcacacactttgtgctcatgtgcatgtgtgagtgcacctcctcaatacacgttcaactagcaacacatctctaatatcactcgcctatttaatacatttaggtagcaatatctgaattcaagcactccaccatcaccagaccacttttaataatatctaaaatacaaaaaataattttacagaatagcatgaaaagtatgaaacgaactatttaggtttttcacatacaaaaaaaaaaagaattttgctcgtgcgcgagcgccaatctcccatattgggcacacaggcaacaacagagtggctgcccacagaacaacccacaaaaaacgatgatctaacggaggacagcaagtccgcaacaaccttttaacagcaggctttgcggccaggagagaggaggagaggcaaagaaaaccaagcatcctcctcctcccatctataaattcctccccccttttcccctctctatataggaggcatccaagccaagaagagggagagcaccaaggacacgcgactagcagaagccgagcgaccgccttcttcgatccatatcttccggtcgagttcttggtcgatctcttccctcctccacctcctcctcacagggtatgtgcccttcggttgttcttggatttattgttctaggttgtgtagtacgggcgttgatgttaggaaaggggatctgtatctgtgatgattcctgttcttggatttgggatagaggggttcttgatgttgcatgttatcggttcggtttgattagtagtatggttttcaatcgtctggagagctctatggaaatgaaatggtttagggtacggaatcttgcgattttgtgagtaccttttgtttgaggtaaaatcagagcaccggtgattttgcttggtgtaataaaagtacggttgtttggtcctcgattctggtagtgatgcttctcgatttgacgaagctatcctttgtttattccctattgaacaaaaataatccaactttgaagacggtcccgttgatgagattgaatgattgattcttaagcctgtccaaaatttcgcagctggcttgtttagatacagtagtccccatcacgaaattcatggaaacagttataatcctcaggaacaggggattccctgttcttccgatttgctttagtcccagaattttttttcccaaatatcttaaaaagtcactttctggttcagttcaatgaattgattgctacaaataatgcttttatagcgttatcctagctgtagttcagttaataggtaatacccctatagtttagtcaggagaagaacttatccgatttctgatctccatttttaattatatgaaatgaactgtagcataagcagtattcatttggattattttttttattagctctcaccccttcattattctgagctgaaagtctggcatgaactgtcctcaattttgttttcaaattcacatcgattatctatcgattatcctcttgtatctacctgtagaagtttctttttggttattccttgactgcttgattacagaaagaaatttatgaagctgtaatcgggatagttatactgcttgttcttatgattcatttcctttgtgcagttcttggtgtagcttgccactttcaccagcaaagtttc

SEQ ID NO: 6056 - DNA, 1358 bp, Ubi-1 Promoter
gtgcagcgtcgcgtcgggccaagcgaagcagacggcacggcatctctgtcgctgcctctggacccctctcgagagttccgctccaccgttggacttgctccgctgtcggcatccagaaattgcgtggcggagcggcagacgtgagccggcacggcaggcggcctcctcctcctctcacggcaccggcagctacgggggattcctttcccaccgctccttcgctttcccttcctcgcccgccgtaataaatagacaccccctccacaccctctttccccaacctcgtgttgttcggagcgcacacacacacaaccagatctcccccaaatccacccgtcggcacctccgcttcaaggtacgccgctcgtcctccccccccccctctctaccttctctagatcggcgttccggtccatggttagggcccggtagttctacttctgttcatgtttgtgttagatccgtgtttgtgttagatccgtgctgctagcgttcgtacacggatgcgacctgtacgtcagacacgttctgattgctaacttgccagtgtttctctttggggaatcctgggatggctctagccgttccgcagacgggatcgatttcatgattttttttgtttcgttgcatagggtttggtttgcccttttcctttatttcaatatatgccgtgcacttgtttgtcgggtcatcttttcatgcttttttttgtcttggttgtgatgatgtggtctggttgggcggtcgttctagatcggagtagaaatctgtttcaaactacctggtggatttattaattttggatctgtatgtgtgtgccatacatattcatagttacgaattgaagatgatggatggaaatatcgatctaggataggtatacatgttgatgcgggttttactgatgcatatacagagatgctttttgttcgcttggttgtgatgatgtggtgtggttgggcggtcgttcattcgttctagatcggagtagaatactgtttcaaactacctggtgtatttattaattttggaactgtatgtgtgtgtcatacatcttcatagttacgagtttaagatggatggaaatatcgatctaggataggtatacatgttgatgtgggttttactgatgcatatacatgatggcatatgcagcatctattcatatgctctaaccttgagtacctatctattataataaacaagtatgttttataattattttgatcttgatatacttggatgatggcatatgcagcagctatatgtggatttttttagccctgccttcatacgctatttatttgcttggtactgtttcttttgtcgatgctcaccctgttgtttggtgttacttc

SEQ ID NO: 6057 - DNA, 1321 bp, rbcS Promoter
ccaagagtcgttgtctccatgacaacgcccccaaggaggaaatcgacgtaaaaacgccgttgtcgcccgatctggccatagccaaatcttaggttttcacccgaagacaccaaacatcaaagtgagggaaagtgaagctcttcgacgacacctccaagaaggaaaacggcgctacaacatcgttgtcttcggcatacctcgcacacgggcagttttcatccagagcaacactccaaacaccggagccgacgtccatacctcgcacacgggcagcagccgaagacgcgaccgaaaatgaaaaccacgccaccatggcatcgaaaaggaccgacttggaccatgtatggccgcagcagcagcccatctgccgccggtgaagttcaatcagccgcctcaccaaactgagaggaaaaatgatggaaacgaagagacctgggacatgccggatcagccggaggagatgacggatctggccaacgagtagctagatccggccgaagagcgccgccgtgaagccgcgcagccacgagcagaccgagcaccagggagaggaagaacgaggggaaacaccggatccgggaggaagccggccggatctagccgaagacgaggcatagcctgccggatcgggccggagacgccgcgaccacgatgaggcagcacctcaaacgcctcagccaagagctctaggacacccccgccaagaaaaacagccccgccgccgccgtccccgtgcgggctttgcccggcggcggcgagggggaggagaggacggggagaggctgctgccggggctggtgtggttgccgcccgtgtcgccccagactgagcgacgcgggggcaagcttcgttctcgataagatcttagaagagtttctcttaatttgttgttcctctagttcataaaaagtgctgctcattttgcattaactcattacaaattttctaataagtgggcgagattttttatggattggagggattagcaagttctgtttttgagtgcatgccgtggcacattggatctatcctgataggtgaaaattggtcacttcatggcatgatttgcagagtgcgttgcagccaattgtatccgtccagaggataacgcgcgccatttcgtgcggccatgtggcgcccgacctgatccgtaggatgccagcgtggcctgggcaaatccgcgcggcgaactgcagccacccctcctagatcttgtgctgatattggatgggtggggagcctacagttatataagccgctgtagctagagagcactcaagcaagcctgcctcctcttgttagctatctacgtacgtgtacg

SEQ ID NO: 6058 - DNA, 1599 bp, AT5G06690 Promoter
ggaccatttgtttagacgacattgttaaggggatgacttaaagtgatgagtttcaaattaaaatacccctcgtttttggagttatttacttaaaatgccacttcaaagaagcgtgtcggtgtgttcgagattcgaattttaattactgtcttttgcccctatctatatatatctcactttaatcacacttttattatcgttaatgtttaatgtttatttatgttaatgaaggattagtggttagtggttgtgttactaattgttcgttgctaatgtccttgaaaggtgtaatttgtatgatctatctaactaaattatccggaaataatgcggttgaaataaaatcacgatacatattaggatatcacaatctatttatagtatattttagtcgagatttgaaaataaaaagggaatatattactcgattaaagacattttcaaacgcaaaatcgtatataactatagattgaatcatatatatatctgtgactcaagtcttttatctttgttttttggtttaatgttaaaactttatatcaacaaagacttttatcttgtatcttatgtttactatttctgatgagtaaatattaattttgtaggtaagtaaggtggcaggtttgggtaaagaggaaatcaaaaatgtatggtaggatagtacttgacaaaatacaaaattctaattcgcgtttattaaagtccttagcgtgtggactctacttgtttaatttcgactctctaaacgtcggcctttattttctttcaaacgtacttcaccaactctattagagagatcgattataaccgacaagcataagtatgtgatttctatattagtttatatatagctatgtcttcgaatgattatttatagtaaacacataattatacgtaataagtccgagagtatataaactatgaaggataattaattgaagacaagaaaattaacgaaatagtgtggggaattcccaaggcatcatattcagatcaatgcaccgtcacaagtttggctattctttatttggttttctgattaacacaaagttttaaatagttttgaacgtttctaatccatttgaggcagtgattttttctgttccaagtattttatgttcaatattattaggaatgtgaacggaacgatttttttttttttttgtggaaccgagcgaccaaatttgagaaaataaaacaaattagattgatttaacatttagacgaggtttaattagaaaggaaaaaaaaaacacaattttatataaatatgaacagccaaaataattttcctagagtttataagttcagggtttacctttttcatagagaaaactaataaagtcactattaacattttaagaatatacatttttaaaacaaattataaagacaatgagagaaaggtagcccccaccagtagcacatcgttggcattgtccaactcatcttccggataagctctctatccatctcctcacatctcttcccaaaactttcaaaaacaaaaaaaatatcttaattatggcatttgaaaacttaaaaatatctcgtcacatatcttcatcgacaaaaaatttactgaaagcgaaaaaaata

SEQ ID NO: 6059 - DNA, 1774 bp, AT5G61520 (AtSTP3) Promoter
ctgttatgaggtgttcttgcacggcatgtctagttgcaggctgctgaagaattgcccaccggcttttaaacaacgacccaactctttctgcaacatctgcaacattcactttcgcatccttagcaacttccccgacaaaactaccagcagtctgccctgcttccctaagcttcgttcctaattcagtaactccatagtaagctttccaccataaacactcacagagagaaacgaaatgaggttagcatagaaattatcaaacctgatgaagaaaagaatccactagtcctctcctgccattgctgtgagatgagagaaggcattatccaataccaaccactttaaacaagtcactagaaacctgtttgcatcaagaaacaaatgggaagatatatacttattcttagcaaattatgatacaacctcacaagcggtattatccgttgtaatcaacttcatcacatgaaatcatcttcaatctaatcatatacaattgatacagaagaaacacaaaagaaaaccaaaaccttgacttcatcgtcaaccatggaatgaatttcttgacaaagaataaaaaccaagtctttaactgccaaaaggagataacttttaaggaacacaaaccctaatcctatattctctaatcaatcatatacgagaatcaaaaagaacaaatagaacaaaagcaatccgatcatcaaacctttagaacaatccccagaaaaattgagatagctgatgatcgaatcgaactaaacccaattcctcgatacgatcaaagacgacgaagacgagagtcagcgatatgatgaaaaagaaattgatcgctccaggagatgaaaaggttccacttttttaatttccccctggagcagagaaaaaaagatattattgctgtttaggtaaaaaaaaagtcggctttgaattttgaataggaaagtcttcttccctttgcaaatcacagatattctctccgtcacggactgtgacggtaataaatattctgttggtgccacgtgtaataagtttttctcttcacaaaaatggtccttcatcttcttttagtatctcatttgtgacctaagcttctaatttcacagcttatcatccccttaatgttttaagttttttgaccatagagtaaaattattttactataaaattaaaagcaaaaaataaaatttactataaaattataattataaaaagtgaatgtaaaaatgattccataaatttacatgattgatagtaattattctgccaacttaattccacatgtatatcagtatttatatatagaaaatgatggtttttctacatagtcaaattccaaaacaaaatatcagtattatggaattaaacaatcaaagtttgcaacttggtatgtccaatatcatcgaaagagctttatcattcagtcgttgaaaaaagtatagccatctttttcttctatcgattttcaaaaaaaaaaaaaaaaaaaaaaaaaaaaaaaaaaaaaaaaaaagaggaagataatgaaggtaggcagtgaaaagtctttcttcacatgtcttttattgtccactttcgatatctcatcagccagaaccgaaacaaacaaaaactataagtcccacactcaagtcaattaaagcactccaatggtccaacaagtttcgtcgtctaccttgaaactcaacctttggatgattgatatacaaaaatacaggatctaaaaacacctaccgaacttgaatagtaggtgtgttgtgtttgagtgtctctctaggtaaac

SEQ ID NO: 6060 - DNA, 1127 bp, NAPIN Promoter
attgattcctttaaagacttatgtttcttatcttgcttctgaggcaagtattcagttaccagttaccacttatattctggactttctgactgcatcctcatttttccaacattttaaatttcactattggctgaatgcttcttctttgaggaagaaacaattcagatggcagaaatgtatcaaccaatgcatatatacaaatgtacctcttgttctcaaaacatctatcggatggttccatttgctttgtcatccaattagtgactactttatattattcactcctctttattactattttcatgcgaggttgccatgtacattatatttgtaaggattgacgctattgagcgtttttcttcaattttctttattttagacatgggtatgaaatgtgtgttagagttgggttgaatgagatatacgttcaagtgaagtggcataccgttgtcgagtaaggatgacctacccattcttgagacaaatgttacattttagtatcagagtaaaatgtgtacctataactcaaattcgattgacatgtatccattcaacataaaattaaaccagcctgcacctgcatccacatttcaagtattttcaaaccgttcggctcctatccaccgggtgtaacaagacggattccgaatttggaagattttgactcaaattcccaatttatattgaccgtgactaaatcaactttaacttctataattctgattaagctcccaatttatattcccaacggcactacctccaaaatttatagactctcatccccttttaaaccaacttagtaaacgctcttttttttaattttatgaagttaagtttttaccttgtttttaaaaagaatcgttcataagatgccatgccagaacattagctacacgttacacatagcatgcagccgcggagaattgtttttcttcgccacttgtcactcccttcaaacacctaagagcttctctctcacagcacacacatacaatcacatgcgtgcatgcattattacacgtgatcgccatgcaaatctcctttatagtctataaattaactcatccgcttcactctttactcaaaccaaaactcatcaatacaaacaagattaaaaacatacaccc

SEQ ID NO: 6061 - DNA, 916 bp, AT1G61720 (BAN)
ttgtacttttgaaattacagagatagagatttagttgttatgagtttatcgtcttgagacttctatataagaagtaaaaagatttgcaaatagtccttgctcattaggtacaacagtagatcaataaggctgttttagaaggtaagcacgtgatctttgaaataaccaacttgtcttcacctaagaatcaaaaaagattgaccttcagagttctgatttgttatcatctaccaaattatcacaagagtttgattatttctgtctctaaacaatataacacagctttagagtaacgaatagtgttacagtaaggttctgttacttcaattttttctttgccgatcttaaaatgagttgcaaaagaatgctttttacttccaccaatctgtcaaattctctgcagtttttaacacaacttggacttgctatgttctgtttcacgaattacacgagtcaattcaacataacttgctctgttcttgtccatgtttcacagaatctggccttaagcaattttatcatatttaagctacaaatccataacagagtttaacaaagataaaataaccagaaagttacattgaaagataaaaagtgaagaagacaaaaaaaagagagggtaaatcctaaatcgaaaacaaaagaaggcattggcaatagcattccgattttaaaaaaccgataaatctatgtatctaatggcttgttcttagaagcttcaacgaacatagaagcaacctcattcaaaaacttagtcttctccaacacaaattccaactccttagcttgcaacaacttatacttctcttcaacaatcttcttactctcaaccgaaaccaaactccattgctgcttcacataatactcatcaacacccaaactagcaatcatcctaacaagagacgagttatcaaac

SEQ ID NO: 6062 - DNA, 4073 bp, AT3G24650 (ABI3)
catgttaagttttactagatacgttctcatctaactagatacgacctaaaatacgatatttgtggttttagttgttagatgttgtgtcacacgagagaaagaggtcgacgaagaaaaaaacaaaaagaagaagtaaaacgtagttattggcggacaagggataaagattgctttgaagtcagaaatgctgacacgtggcagcatatgaagacaacccgccgcttaaaaccacgaatggtgacgaaaggcttctttgtttgcatgtgcaaccaatctctctctttctctctgtctttactaattttggttgttcgtagaaaatgaaatatttgaacgaagaagataaaggttggtgatgtacgtatgactctaaattagagtttgataatttgtatgtaagattagatcggttttgttatttgcttgatccaatttattgaagtacatgtgaataatcgtgatatatgtcaatatatatgtgctataattaaatctattaacaaatttctttttatcgatttagttacaccatctttaatatatttctattttctattttaaactaaagcatagtttctccaatatattaatttatatatttactctaggatagaattagattcaaaaactagaatagagaatatagatgctctaaatagacaataattctattacttactctattttagagtaaaacatatagtgatgctgacaaaaatattattttataatagagtttagaaagaaaagaaaaaacaaaaaaaacttgaagatgctggaactattaaaaattaaagaaaaagtttaaaatgaataatgctttttattcttagttttttttttcttttttttcttttagttgatgttaaagttttagtcaaatctccaaaatttgcaaaaaagatacattagttacggacggatatatattaaataaattaagtcacaaatatcatatatatatatatatatattaattttttgcctagttttgttccaaataaaattttcaatttttagtgtacaatatttttcatcgtccaaatacacaaacacaacaaataataataccactaatttatttgttttctaatataattgaaccttttctaattttattaaataggctgaaaaccataaattatttggagccaagattaaattatgttacataaatccttttctcgtcatcaatactcaaatttaaatttttttattttcatagatatttttgggaatttaaaatccttccaaataaatttgggaaaataatagatgttttaaaatatttttgttattttcgagtagtttacactgattttacatcactttatggatcaagaccataaaatttaactacatttattataacttatttgaaaagacatgaaactttcattagagtttaggaaaatacggcaaactattagattatcaccctcttgtgactaatgttaatactatttggtaaagcaaataatcccataactaattttattttgatttgttcactatcaattgtatcatagacgatccgatgattaatgtacctaaattttgatttaaattgtattccttgtagtacgcatagtaaaacaaagttcacatgttcttttacaattggttttctaacattttagatttcattttaaactaaagaaaaagggtttttcgatcccaacaatttttaaagtatgtttttgaatttcaacaaacgactagtactgatatatacatcaatgcttacaaaaatcaaattatctatctcaacgtttacttttgtacgtaattacaagtcaatattaacaaatattagtcaactgtaacggttgttgactcaattgatacgtgtacgtttaggtggcatgttttttaataaaataattttgttttatgttttgggattaaaaatatttacttttaaaaaactaaaccgaaaaactggaacccccaacctcacatattcatcaccatcgtatccacaaacattatcgagacataaataataatttatagatatatagcaacaaattggaattaaattaatcaaacaatgtcatttagaattggggaaatcctaaccgacgttatatgattaattttaattccaatttatgtatgtgtatatatctataaattattatttatatattgatgatgttcgtgcatgatggtaatggtaacctttaaaacttttgaatctcaaaacgtaaaacaacgtcatttggtttgaagaacatgccatctcgacgtacaagtgttagctgattcaacaaccgttactgttaattaccataactaacgttgactcataattatgtacaaaagtaagagttgaggtagataatttgaattttttaaatgttaaagtatgaacattactaattgtttgttcagatttataaaacacagtacctattttgatgtgttaaaatgtaatcgggaaaataggaattttcccaagaaaaaaaaatacactaaaattttgatgtgttaaaatgtaataaatacaagtacctatttctttctacaacaggtatcacatgatctgctcaatctcattttgaaggcaaggtcgaaccctgtttgtaactaaatattttacaaatacactaaaagttttgttttgttttcctcatgcagaaaaaagaaaagaaagaagaagaaaaaaaactcacaaaaacatacattgttctacaatatgttaaagtaattgttctagggtaataaaatccgtgtctgcctcttccacttcaataggaaagtgtaagtttttcgaatctttttggccagataatttaaaaccgaccgaggaaacttacttttgtaaaagtgaccatttgcacataggaagtagaaagttgataattggaaaatttataatattttatacaaaagaagtgtttaagaaccaccgcttggtctcaccactcaaattcgaacgtatggctcgtgggcacaaactcctgtaccaacctttagatactagcggcacgaggagacttctattttctctttgtttttaagtttttttatcgacttaaatatggctttttgcaccatttaatttcaaaaccaatgtctttctctcgaggaactttgtttttatttcttagaagatgaggggagatttactatctaaataaaattttaaatgtttgtaagtattatgagctcaacaattttgtcaatagtgccacaaatttaaacgtttgctttttgtcttctttgaaaaatcaaatgctgaaaaactgttacatctctttttcttaaaaactcttgtctctctccttttccttctgctgaggtaattgaatgctgcaaagagaaagagaataacttaaacccaaaattacacttaccgccagaaaaaaaaaagagttcagtttaatctaacatattttatacaatacaattgaattatattagtaaaaaaaaaacttccatataaatcatggaacaaactggaacacatgggctctcttattttaatttattttcttttttgagggatttaaccatgtttattatatagttttataaatatatatataccatctctccataatttataaaatgaaagaaagagagagtcttcttgttggagtaaacccaaacggttttagattacttattagctgttcatcagttcttcctctctaaaagagtaaaacctaaacatctctctctgttctattagaaccaaagaccaatctttgtgaacaaaacacatctcgtatacttcagatctagactcgaaaattttagacctctttacaattggtctttgttcatctgaagttggagaaaatagttagcttaggtcggatcttttcatatgctttggatcctccttcgtctcttttgtataattttaaccttatcaagagttctttttgaatctcaaaagattatatagtagtatagaaggtttatatgtatatgtatagccagatagtttatgttgtttaaagattcgatgatagccaagttgggttaactttctttttccttgcctccttactcacatacaaaccctatctgtccgtacaaaatactaaaaaccctaactt

SEQ ID NO: 6063 - DNA, 1700 bp, AT1G69120 (APETALA 1)
ttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagct

SEQ ID NO: 6064 - DNA, 1096 bp, RootP Promoter
tcagatgaagaaggcggcttttgcacgatttcataatggctacgtatttggcagataaagttattgtgtatgaaggagaaccttccgtggattgcacggcatcttctcctcagtctctacgtagtggaatgaatttgttcttgtctcgtttgaacatcactttcagacgagatcctacgaatttcagaccaagaatcaataaactcgattcgatgaaggatagtgaccagaagcttgcgggatgttattactacttggatgattaagagagagatgacattgagagaatctttcaccggagaaaacctgaagtagtgagaaactcacgttttgatctttcctagccccttcaatctattataagatctcttgaattttattagatccatctggagtttaatttttgagaatatattatggtgtttgaattcggtttgtttcaatcgttcccatatattagactagtttttttcttcacacatgagaatctcaaaccgattgcgtagaagaagaactcgcattcatctgtttttgtctttagttgagaatgaatgaccgttgtaatgtcatgggcttcttttggtttgggtctgaatcacttaagcccaacacaatctcttcttaggttgaaacactgttgtttttgctgttttgtctgacacaaggcatcggatgatgtcgattgtcgaatatgcttcctcattcggagtgttctcagacatcttgagcttctcattagttaggcggtgcgctcgaaagtcgaagccgtgttgacatatcaaaacattgggaccattcaattttgtacaaatgtccaaacattatttcggtttgataacaataaacaaataaagaaagagttttttattggattcacttggcaacagccaacaacgaatcaaataatctatatacataattatattagaagctgtgaatgtgcctccgagtagacaaaagcacatgcaccataaatgatcaaacccatgaaacttccatctctctttttcccctatataaactaatgtcacttacctcaatattccatcaacaatatacatctgagatatcaaaactcctagagagatctaataaa

SEQ ID NO: 6065 - DNA, 2103 bp, Pho1 Promoter
actgtttaaggacaaaaaatgtggaactgatgtctcctaggtggtggaatatgtgaagctagaaaacaaataaatgcggtccgactcagaccatcattttcctcttgtctcattggttttaaaattaaatattatattataaaatctgttgcagtattttttttaatctcaattagagttatttatttaggtctcaacccatggtggggaaaaaaacagctattttaggtaaatttagattacaaaattgtatagtcaatatcaataataggttaaagttttaataaactgggtgaatcagtttttgtttggtcttcttggatctttgtttggtctcaatattttggattacatataaattccatcccgactattatttgggttttgccgctggactctataacacactgattttagttttatatgaattttacgttgttttacgtttgatcatgaactaaaaattcagcaatccataagaaaatattttttggactagttcgaaactcggccagacaatactaaacctattcacatatttaactttttttttttttggacaaacataattaactttagtaagtgttatatttttgtcaatattaaactagatgtggtgtttttaattgtgggaaataaaattaaagaagcaaagttccatgaaatatggactttccgtaattggaaggccgccatatgttgccttcatttgtattttccttttattgacccttttgttttcttataagataaatatatatataactaattaggcagaagctgagtggcattagttagtgaaatatatttatcattatcccaaattcctctagctgacattactttgaatttagaaatttcttatccgcaaaatttgtactaatattatgaagtagtacatcgaatagaatatatattggtgcacattatgatccactttcaatgccatccattcgaatggttgctcagaacgtacttgtagaaaccgcgtgcataaagtttcatatgagcatcgtgtgctttgttatttaattttttcttccctaaataatcagacagaaaaattcataaacttctttaataaaaccatccaaaaggggattatactacgaaaattatggcatctaaacgcaaagtttaatatatttttagtaccaatgcattgtaaaagaatggaaattaaataaaaacaatatgaaactgtttgttcccttggacaaaaaaaaaacttggtatgactatgatttttatatgcgcttttgtaattgcattgtaattttgtcgatatggaagtggattttaaagaacattaatccatgatctgataggtgaaaactcacactacttgactgctatataacatggtttggtagtatctgcatttgtaatgtgaaactatgaaatcagaatttgattggtaattcttcttctgcttcttttttcttgattctttaagatttagtatgtgtttcaaatttttcattgtcctccgaaaaaatgtagtggaaatcgagctggtccaatctaagttcactcaccttttgtgtctcttggcacctaatttctttttggtccatttcagctatcttcttccttttccacacaaaacattacaaaatacttactatttctagttctccgatttacaatacccaaattacccttacccttgcccctcatatagttcgtataacaactttcactctaagatgaaacattttgagtgttgagaaaggtatatgaagctcggtagccggaggaagcacggtggatatacactggcgagaatcaggacggtcccacacgagacaagatttacctctcccaaaagcacaagtggaaggagcataggataaaaattagtacatgaaattaggtttcaagaaggatatttgagaatgtgctttgtgaggcatcgtcagtaggagtaagcaatccagtcaaatatattcttctttttttctctgcctttgcttttgtccactataaaacaaatctcatcctcctctcttgccctacactcacaaaacaaacacactctcttcttgatcattttctcttttgagtttttgagtttaaggacttaaaagagaaaacgctatg

SEQ ID NO: 6066 - DNA, 277 bp, NOS TERMINATOR
gagctcgaatttccccgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgggaattc

SEQ ID NO: 6067 - DNA, 36 bp, Artificial Sequence
  primer
tatggtacctcaaaatgataaaaacttctagaagcc

SEQ ID NO: 6068 - DNA, 31 bp, Artificial Sequence
  primer
aaaggtacctctcaacggattcagattgttg

SEQ ID NO: 6069 - DNA, 37 bp, Artificial Sequence
  primer
tttggtaccttgttagaattatgtaaactttgaacgc

SEQ ID NO: 6070 - DNA, 32 bp, Artificial Sequence
  primer
aaaggtaccgaagttgttcccattatttgttg

SEQ ID NO: 6071 - DNA, 32 bp, Artificial Sequence
  primer
aaagaattccaagtggacatttctagctggtc

SEQ ID NO: 6072 - DNA, 31 bp, Artificial Sequence
  primer
aaagaattctacaagccaacagttcatgtgc

SEQ ID NO: 6073 - DNA, 35 bp, Artificial Sequence
  primer
aaaggtaccctatgcagttaacgtcttccaagttc

SEQ ID NO: 6074 - DNA, 30 bp, Artificial Sequence
  primer
aaaggtacccaaactttgatgccacattcc

SEQ ID NO: 6075 - DNA, 36 bp, Artificial Sequence
  primer
aaaggtaccctataggacaacatacaagacagccag

SEQ ID NO: 6076 - DNA, 31 bp, Artificial Sequence
  primer
aaggtaccaaggaattatgcaccctgtcttg

SEQ ID NO: 6077 - DNA, 31 bp, Artificial Sequence
  primer
aaagaattcagatggaagcatattgagcagg

SEQ ID NO: 6078 - DNA, 31 bp, Artificial Sequence
  primer
aaaggtacctaacattatgcgcattcagctc

SEQ ID NO: 6079 - DNA, 31 bp, Artificial Sequence
  primer
aaaggtacccaatggccaggtaacgttctac

SEQ ID NO: 6080 - DNA, 35 bp, Artificial Sequence
  primer
tttggtaccttatcatctattccatgacaggttcg

SEQ ID NO: 6081 - DNA, 33 bp, Artificial Sequence
  primer
aaaggtaccctaactgccgcactgtagtaaacg

SEQ ID NO: 6082 - DNA, 31 bp, Artificial Sequence
  primer
aaagaattcgcaccattcatcacagtagcag

SEQ ID NO: 6083 - DNA, 31 bp, Artificial Sequence
  primer
aaaggtaccctaagcgaacaaggtcatctcg

SEQ ID NO: 6084 - DNA, 31 bp, Artificial Sequence
  primer
aaagaattcctcaagggttacatgagtgctg

SEQ ID NO: 6085 - DNA, 31 bp, Artificial Sequence
  primer
aaaggtaccaggagtatgtcacaacgcacac

SEQ ID NO: 6086 - DNA, 36 bp, Artificial Sequence
  primer
tttaggcctttacagagactaagaaccggggttacc

SEQ ID NO: 6087 - DNA, 31 bp, Artificial Sequence
  primer
aaaggtaccattcgcagaagatgagaaccac

SEQ ID NO: 6088 - DNA, 31 bp, Artificial Sequence
  primer
aaaggtaccaaattgggtgtccaaacgtaag

SEQ ID NO: 6089 - DNA, 31 bp, Artificial Sequence
  primer
aaagaattcatccaaccaagcactagcaaac

SEQ ID NO: 6090 - DNA, 32 bp, Artificial Sequence
  primer
tttggtaccgaggaagtggatcatgtgcgagc

SEQ ID NO: 6091 - DNA, 31 bp, Artificial Sequence
  primer
aaagaattcgtccctctacggaacctactcc

SEQ ID NO: 6092 - DNA, 31 bp, Artificial Sequence
  primer
aaaggatccttagacaaagggaacaagcgag

SEQ ID NO: 6093 - DNA, 31 bp, Artificial Sequence
  primer
aaaggtaccaaagtaacctctcacgctcacg

SEQ ID NO: 6094 - DNA, 30 bp, Artificial Sequence
  primer
tttaggcctttaggaacacgtggtgcatca

SEQ ID NO: 6095 - DNA, 31 bp, Artificial Sequence
  primer
aaaggtaccaaatcaggaagcagacatggac

SEQ ID NO: 6096 - DNA, 31 bp, Artificial Sequence
  primer
aaaggtaccctctacgtcaaccactccttgg

SEQ ID NO: 6097 - DNA, 29 bp, Artificial Sequence
  primer
aaaggtaccacgacaaccacgagcaaatc

SEQ ID NO: 6098 - DNA, 33 bp, Artificial Sequence
  primer
aaaggtaccctaacccaacccaagcagatagtc

SEQ ID NO: 6099 - DNA, 31 bp, Artificial Sequence
  primer
aaaggtaccactttccatgaaagaagggcag

SEQ ID NO: 6100 - DNA, 31 bp, Artificial Sequence
  primer
aaagaattcgattctcaacttctcagccagc

SEQ ID NO: 6101 - DNA, 32 bp, Artificial Sequence
  primer
aaaggtaccttgctaggttgcattatggattc

SEQ ID NO: 6102 - DNA, 32 bp, Artificial Sequence
  primer
aaaggtaccgggattattcagatcgaggtttg

SEQ ID NO: 6103 - DNA, 31 bp, Artificial Sequence
  primer
aaaaggcctaatataaacgacacggcaaagc

SEQ ID NO: 6104 - DNA, 30 bp, Artificial Sequence
  primer
aaagaattctcgaattgtccaatgatttcg

SEQ ID NO: 6105 - DNA, 30 bp, Artificial Sequence
  primer
aaaggtaccttatgcaccgacaacatcatc

SEQ ID NO: 6106 - DNA, 31 bp, Artificial Sequence
  primer
aaaggtaccatccaatccattccttgactcc

SEQ ID NO: 6107 - DNA, 31 bp, Artificial Sequence
  primer
aaaggatcctcatgttcatcacacgtcaaag

SEQ ID NO: 6108 - DNA, 36 bp, Artificial Sequence
  primer
tttggtaccttagcttgtagacttccgaaaatttcc

SEQ ID NO: 6109 - DNA, 34 bp, Artificial Sequence
  primer
tttgaattcttaggcaaacagagaagcatcaaac

SEQ ID NO: 6110 - DNA, 31 bp, Artificial Sequence
  primer
aaaggtaccaaccgaactctgaactaggcac

SEQ ID NO: 6111 - DNA, 34 bp, Artificial Sequence
  primer
tttggtaccaggatcatgactattaaactcaggg

SEQ ID NO: 6112 - DNA, 31 bp, Artificial Sequence
  primer
aaaggatcctgatgctgctatcatgtgtctg

SEQ ID NO: 6113 - DNA, 33 bp, Artificial Sequence
  primer
tttggtaccctaagcgcttcagctgacctaatc

SEQ ID NO: 6114 - DNA, 32 bp, Artificial Sequence
  primer
tttgaattctcacaagctccagtgcacaactc

SEQ ID NO: 6115 - DNA, 31 bp, Artificial Sequence
  primer
aaaggtaccagtcacagcatcattaccatcg

SEQ ID NO: 6116 - DNA, 31 bp, Artificial Sequence
  primer
aaaggtaccaagaaaccacggtgacaaagac

SEQ ID NO: 6117 - DNA, 31 bp, Artificial Sequence
  primer
aaaggtaccgacaggaaacacgtacaagctc

SEQ ID NO: 6118 - DNA, 31 bp, Artificial Sequence
  primer
aaagaattcaaacagcacccaccatacaaac

SEQ ID NO: 6119 - DNA, 31 bp, Artificial Sequence
  primer
aaaggtacccccgtttactcaaaggacagac

SEQ ID NO: 6120 - DNA, 33 bp, Artificial Sequence
  primer
aaaggatccctagcaattcaaaccaggacaatg

SEQ ID NO: 6121 - DNA, 34 bp, Artificial Sequence
  primer
tttgaattcctagacccaacccttctatgtcatc

SEQ ID NO: 6122 - DNA, 31 bp, Artificial Sequence
  primer
aaaggtaccctggacaatttacaaccacctg

SEQ ID NO: 6123 - DNA, 31 bp, Artificial Sequence
  primer
aaagaattcccaatcctcctaaagctagcac

SEQ ID NO: 6124 - DNA, 31 bp, Artificial Sequence
  primer
aaagaattccttcttccttccgacagtcaag

SEQ ID NO: 6125 - DNA, 31 bp, Artificial Sequence
  primer
aaaggtaccactacactgcgttgttgtttgc

SEQ ID NO: 6126 - DNA, 30 bp, Artificial Sequence
  primer
aaaggtacctatcatcttcctcgtggcatc

SEQ ID NO: 6127 - DNA, 31 bp, Artificial Sequence
  primer
aaaggtacccaacacctcacttctcacaagc

SEQ ID NO: 6128 - DNA, 30 bp, Artificial Sequence
  primer
aaaaggcctcgccaacagaaacagaaagtg

SEQ ID NO: 6129 - DNA, 31 bp, Artificial Sequence
  primer
aaaggtaccgacgacgatgaccgaattaaag

SEQ ID NO: 6130 - DNA, 31 bp, Artificial Sequence
  primer
aaaggtaccattgaaagagcacagtccacac

SEQ ID NO: 6131 - DNA, 31 bp, Artificial Sequence
  primer
aaaggatcctaggtgcttctacgcttcactg

SEQ ID NO: 6132 - DNA, 31 bp, Artificial Sequence
  primer
aaaggtaccaaggattaggtgcctaacggac

SEQ ID NO: 6133 - DNA, 31 bp, Artificial Sequence
  primer
aaagaattccatacaggcctaccaatcatcc

SEQ ID NO: 6134 - DNA, 29 bp, Artificial Sequence
  primer
aaaggtacccaggcgtgtcatctcatctg

SEQ ID NO: 6135 - DNA, 31 bp, Artificial Sequence
  primer
aaaaggccttagctattcgcctattccgacc

SEQ ID NO: 6136 - DNA, 31 bp, Artificial Sequence
  primer
aaaggtaccccacgatatgcagtgttctgtg

SEQ ID NO: 6137 - DNA, 33 bp, Artificial Sequence
  primer
aaagaattcaaactaggccattattcacagctc

SEQ ID NO: 6138 - DNA, 32 bp, Artificial Sequence
  primer
aaaggatcccaagggcatatcagaaactgaac

SEQ ID NO: 6139 - DNA, 30 bp, Artificial Sequence
  primer
aaaggtaccgcaaatttgaaatcgagcaag

SEQ ID NO: 6140 - DNA, 31 bp, Artificial Sequence
  primer
aaaggtaccaaacatgtgaccaagaaattcc

SEQ ID NO: 6141 - DNA, 27 bp, Artificial Sequence
  primer
aaaggtacctcccagagctgccatttg

SEQ ID NO: 6142 - DNA, 32 bp, Artificial Sequence
  primer
aaaggtaccccaactccaagaacagatctacg

SEQ ID NO: 6143 - DNA, 31 bp, Artificial Sequence
  primer
aaactcgaggcagatggaagacttgagatcc

SEQ ID NO: 6144 - DNA, 27 bp, Artificial Sequence
  primer
aaaggtacccagcggaatcaacgatgg

SEQ ID NO: 6145 - DNA, 31 bp, Artificial Sequence
  primer
aaagatatcttgctgcttcatttcttcacag

SEQ ID NO: 6146 - DNA, 35 bp, Artificial Sequence
  primer
tttgaattcctgtcaacccatgatatataccaagg

SEQ ID NO: 6147 - DNA, 31 bp, Artificial Sequence
  primer
aaagatatcctaactccaggtggggaaattg

SEQ ID NO: 6148 - DNA, 31 bp, Artificial Sequence
  primer
aaagaattctacctctcgccacccataatac

SEQ ID NO: 6149 - DNA, 33 bp, Artificial Sequence
  primer
aaaggtaccctaaagaatgcatttcaccgaatg

SEQ ID NO: 6150 - DNA, 31 bp, Artificial Sequence
  primer
aaaggtacccccttagcttaggcattcactg

SEQ ID NO: 6151 - DNA, 31 bp, Artificial Sequence
  primer
aaaggtaccgacgacaacacgtacaatcagg

SEQ ID NO: 6152 - DNA, 32 bp, Artificial Sequence
  primer
aaagaattctccatctactgagagaatcggtg

SEQ ID NO: 6153 - DNA, 30 bp, Artificial Sequence
  primer
aaaggtaccgccatcattgccacattagag

SEQ ID NO: 6154 - DNA, 34 bp, Artificial Sequence
  primer
aaaggtaccctaacagcacgaatcatacgtcaac

SEQ ID NO: 6155 - DNA, 31 bp, Artificial Sequence
  primer
aaagaattcaaggtaacaagggtcggtcatc

SEQ ID NO: 6156 - DNA, 31 bp, Artificial Sequence
  primer
aaactcgagatgctttctattgctcacctgg

SEQ ID NO: 6157 - DNA, 34 bp, Artificial Sequence
  primer
aaaggtaccctagagcagatcctgcgaactaaag

SEQ ID NO: 6158 - DNA, 31 bp, Artificial Sequence
  primer
aaaggtaccaattctcttgcgttcgattctg

SEQ ID NO: 6159 - DNA, 31 bp, Artificial Sequence
  primer
aaagaattcactaaatatcccggcaaaggag

SEQ ID NO: 6160 - DNA, 31 bp, Artificial Sequence
  primer
aaagaattcatatgtacaggctcggcaactc

SEQ ID NO: 6161 - DNA, 31 bp, Artificial Sequence
  primer
aaaggtaccccttggtaatcagggtatgacg

SEQ ID NO: 6162 - DNA, 31 bp, Artificial Sequence
  primer
aaaggtacctgcgatcacaaacaacgagtag

SEQ ID NO: 6163 - DNA, 31 bp, Artificial Sequence
  primer
aaaggtacctgcatcctatttacacctctgc

SEQ ID NO: 6164 - DNA, 30 bp, Artificial Sequence
  primer
tttggtaccttagtggcgtctaccaatccg

SEQ ID NO: 6165 - DNA, 31 bp, Artificial Sequence
  primer
aaaggtaccaacacgatgcaaacactagcac

SEQ ID NO: 6166 - DNA, 31 bp, Artificial Sequence
  primer
aaaggtaccacagcaacctgaagatggtttc

SEQ ID NO: 6167 - DNA, 32 bp, Artificial Sequence
  primer
aaaggtaccctaacccgtgtacagcgtctgat

SEQ ID NO: 6168 - DNA, 32 bp, Artificial Sequence
  primer
aaaggatcccgtacaaacataaacccacttgc

SEQ ID NO: 6169 - DNA, 31 bp, Artificial Sequence
  primer
aaaggtaccttcagcagcttacatcgcatag

SEQ ID NO: 6170 - DNA, 29 bp, Artificial Sequence
  primer
aaagaattcgacgacggctacgaatcaag

SEQ ID NO: 6171 - DNA, 31 bp, Artificial Sequence
  primer
aaaggtacctcttgaagggataggtagctgg

SEQ ID NO: 6172 - DNA, 31 bp, Artificial Sequence
  primer
aaaggtacctccttgcattattgagcatttg

SEQ ID NO: 6173 - DNA, 29 bp, Artificial Sequence
  primer
aaaggtaccactgacagccaaaggacacc

SEQ ID NO: 6174 - DNA, 31 bp, Artificial Sequence
  primer
aaaggtaccggaaggtagcttcagagattgg

SEQ ID NO: 6175 - DNA, 31 bp, Artificial Sequence
  primer
aaaggatccgtgagtcatcacattctcctgc

SEQ ID NO: 6176 - DNA, 31 bp, Artificial Sequence
  primer
aaaggtaccgatacgagcgcaaacataaagg

SEQ ID NO: 6177 - DNA, 31 bp, Artificial Sequence
  primer
aaaggtaccgcagtacacagtgtctcccaac

SEQ ID NO: 6178 - DNA, 33 bp, Artificial Sequence
  primer
tttggatccctaaccagcagacccaaacacaag

SEQ ID NO: 6179 - DNA, 32 bp, Artificial Sequence
  primer
aaaggtaccatttgttagcacattcagcaacc

SEQ ID NO: 6180 - DNA, 31 bp, Artificial Sequence
  primer
aaagaattctcaagatcacaagtgaccatcc

SEQ ID NO: 6181 - DNA, 31 bp, Artificial Sequence
  primer
aaaggtaccgatcgatgattaagcacagcac

SEQ ID NO: 6182 - DNA, 31 bp, Artificial Sequence
  primer
aaaggatcctacaccttctacagagcccagc

SEQ ID NO: 6183 - DNA, 31 bp, Artificial Sequence
  primer
aaaggtaccacaagatcaagcaatcaaatgg

SEQ ID NO: 6184 - DNA, 31 bp, Artificial Sequence
  primer
aaagaattctcctatgtgttgcgttatgctc

SEQ ID NO: 6185 - DNA, 31 bp, Artificial Sequence
  primer
aaaggtacccaaagcacaatgcgattaacag

SEQ ID NO: 6186 - DNA, 31 bp, Artificial Sequence
  primer
aaaggtaccatgtcagtgaacaatgtggagg

SEQ ID NO: 6187 - DNA, 31 bp, Artificial Sequence
  primer
aaaggtacccacaagaatgtacacggaatgc

SEQ ID NO: 6188 - DNA, 30 bp, Artificial Sequence
  primer
aaaggatccaaacacaaatgacatggcgac

SEQ ID NO: 6189 - DNA, 31 bp, Artificial Sequence
  primer
aaaggtaccgtttcaaatttcccgctaaacc

SEQ ID NO: 6190 - DNA, 21 bp, Artificial Sequence
  primer
ggtgtcacagccttcatcatc

SEQ ID NO: 6191 - DNA, 31 bp, Artificial Sequence
  primer
aaaggtaccaatatgtacaagacgcccttgg

SEQ ID NO: 6192 - DNA, 34 bp, Artificial Sequence
  primer
aaaggtaccctaccacgttccatgatctctactg

SEQ ID NO: 6193 - DNA, 30 bp, Artificial Sequence
  primer
tttggatccttatgaccggacacatggatc

SEQ ID NO: 6194 - DNA, 31 bp, Artificial Sequence
  primer
aaagaattcgaattgccacaacaatcacaac

SEQ ID NO: 6195 - DNA, 31 bp, Artificial Sequence
  primer
aaagaattcaaatcaaacacctaacgcaacc

SEQ ID NO: 6196 - DNA, 31 bp, Artificial Sequence
  primer
aaaggtaccgggagttacacaaatctggacc

SEQ ID NO: 6197 - DNA, 32 bp, Artificial Sequence
  primer
aaaggtacctcggtagcaaagaagatacaacg

SEQ ID NO: 6198 - DNA, 31 bp, Artificial Sequence
  primer
aaaggtaccgagacacagaagcctaacatcg

SEQ ID NO: 6199 - DNA, 31 bp, Artificial Sequence
  primer
aaaggtaccgtcacttaggcaccaggcatac

SEQ ID NO: 6200 - DNA, 31 bp, Artificial Sequence
  primer
aaaaggcctccgctatattggtcaatggaag

SEQ ID NO: 6201 - DNA, 31 bp, Artificial Sequence
  primer
aaaggtaccccttactttccttgagtggtgc

SEQ ID NO: 6202 - DNA, 31 bp, Artificial Sequence
  primer
aaaaggcctaagcagactcaactgccaattc

SEQ ID NO: 6203 - DNA, 31 bp, Artificial Sequence
  primer
aaaggtacctcagcccaacttaacattctcc

SEQ ID NO: 6204 - DNA, 31 bp, Artificial Sequence
  primer
aaaggtacctgtcactggaattcaaagcaag

SEQ ID NO: 6205 - DNA, 31 bp, Artificial Sequence
  primer
aaaggtacccgagttgaagaggaacaagagc

SEQ ID NO: 6206 - DNA, 31 bp, Artificial Sequence
  primer
aaaggtaccccttccaacccatgatagtcac

SEQ ID NO: 6207 - DNA, 34 bp, Artificial Sequence
  primer
aaaggtaccctatatcttcaccatcgatctcacg

SEQ ID NO: 6208 - DNA, 31 bp, Artificial Sequence
  primer
aaagaattcctcttacgaaattcggtgatgc

SEQ ID NO: 6209 - DNA, 31 bp, Artificial Sequence
  primer
aaaggtaccagtgaacactcgtgcaacaaac

SEQ ID NO: 6210 - DNA, 31 bp, Artificial Sequence
  primer
aaaggtaccttacagaaagcccatcgacatc

SEQ ID NO: 6211 - DNA, 31 bp, Artificial Sequence
  primer
aaaggatccatagacaatcgaccacgtcagg

SEQ ID NO: 6212 - DNA, 31 bp, Artificial Sequence
  primer
aaaggtaccgatacagacacggagacacctg

SEQ ID NO: 6213 - DNA, 34 bp, Artificial Sequence
  primer
aaagaattcactaatggacttcaataggaccacc

SEQ ID NO: 6214 - DNA, 31 bp, Artificial Sequence
  primer
aaaggtaccgcatctctgggtctctacaagg

SEQ ID NO: 6215 - DNA, 31 bp, Artificial Sequence
  primer
aaaggtaccagagtgacacagaaatcggagc

SEQ ID NO: 6216 - DNA, 35 bp, Artificial Sequence
  primer
aaaggtaccctaagctagcatgcataacaatggag

SEQ ID NO: 6217 - DNA, 31 bp, Artificial Sequence
  primer
aaaggtaccgtccagcaaactcacttcacag

SEQ ID NO: 6218 - DNA, 33 bp, Artificial Sequence
  primer
aaagaattcctaagcagagtatggttccctgtg

SEQ ID NO: 6219 - DNA, 33 bp, Artificial Sequence
  primer
aaaggtaccctacggaaaggaaacgactggtag

SEQ ID NO: 6220 - DNA, 32 bp, Artificial Sequence
  primer
tttgaattcttaggcgactgttgagattccac

SEQ ID NO: 6221 - DNA, 31 bp, Artificial Sequence
  primer
aaaggtaccaattcattcacgttaagggctg

SEQ ID NO: 6222 - DNA, 31 bp, Artificial Sequence
  primer
aaaggtaccctctgtcaaactcacaaggcac

SEQ ID NO: 6223 - DNA, 35 bp, Artificial Sequence
  primer
aaaggtaccctaagtatcatctcgactcccacaag

SEQ ID NO: 6224 - DNA, 31 bp, Artificial Sequence
  primer
aaaggtacctgcatgcctgtctatctagtcg

SEQ ID NO: 6225 - DNA, 31 bp, Artificial Sequence
  primer
aaaggtaccctaatccagttcctgccatctg

SEQ ID NO: 6226 - DNA, 31 bp, Artificial Sequence
  primer
aaaggtacccacacgcacttcctatagttcc

SEQ ID NO: 6227 - DNA, 31 bp, Artificial Sequence
  primer
aaaggtaccgattaaagttgaacgaccgagc

SEQ ID NO: 6228 - DNA, 31 bp, Artificial Sequence
  primer
aaaggatccgggctaccaaagtaggccttag

SEQ ID NO: 6229 - DNA, 31 bp, Artificial Sequence
  primer
aaaggtacccatctctctccctcaccaagac

SEQ ID NO: 6230 - DNA, 32 bp, Artificial Sequence
  primer
aaaggtaccaatatgcacacatgctgacagac

SEQ ID NO: 6231 - DNA, 34 bp, Artificial Sequence
  primer
aaaggtaccctaaccgaaacagatcctaacaacg

SEQ ID NO: 6232 - DNA, 31 bp, Artificial Sequence
  primer
aaaggtacctcttagttgaagctggcaacag

SEQ ID NO: 6233 - DNA, 31 bp, Artificial Sequence
  primer
aaaaggcctgcttggatagcatgacaaacac

SEQ ID NO: 6234 - DNA, 31 bp, Artificial Sequence
  primer
aaaggatccacagggagaaacaattcagcac

SEQ ID NO: 6235 - DNA, 31 bp, Artificial Sequence
  primer
aaaggtaccagaagcaacagtctgagccttg

SEQ ID NO: 6236 - DNA, 31 bp, Artificial Sequence
  primer
aaaggatcctcattgtccaaacattcaaacg

SEQ ID NO: 6237 - DNA, 37 bp, Artificial Sequence
  primer
tttggtaccttatcccataatttttcaacaacttttg

SEQ ID NO: 6238 - DNA, 31 bp, Artificial Sequence
  primer
aaagaattccacaaacaatagcgaatgaagg

SEQ ID NO: 6239 - DNA, 34 bp, Artificial Sequence
  primer
aaaggtaccctaggaattgacattgagaatgttg

SEQ ID NO: 6240 - DNA, 32 bp, Artificial Sequence
  primer
aaagagctccgattacatctcacgatcgaaac

SEQ ID NO: 6241 - DNA, 33 bp, Artificial Sequence
  primer
aaaggtacctggacatgactattagtggacacc

SEQ ID NO: 6242 - DNA, 31 bp, Artificial Sequence
  primer
aaagaattctagcatacaatggaacgcaaac

SEQ ID NO: 6243 - DNA, 31 bp, Artificial Sequence
  primer
aaaggatccattggtcaccagcattaaaacc

SEQ ID NO: 6244 - DNA, 31 bp, Artificial Sequence
  primer
aaaggtacccaaatgatttacacaaccgcag

SEQ ID NO: 6245 - DNA, 33 bp, Artificial Sequence
  primer
aaaggtacctgtgttcttccaatatccacaaac

SEQ ID NO: 6246 - DNA, 31 bp, Artificial Sequence
  primer
aaaggatcctccaaaccagaaaggaactagc

SEQ ID NO: 6247 - DNA, 33 bp, Artificial Sequence
  primer
aaaggatcctttctgcaaatttcaactacaagg

SEQ ID NO: 6248 - DNA, 37 bp, Artificial Sequence
  primer
tttggtaccttattaccaacagaaagaagaaggtaac

SEQ ID NO: 6249 - DNA, 37 bp, Artificial Sequence
  primer
tttggtaccctattataagttattttgccacaaaaca

SEQ ID NO: 6250 - DNA, 30 bp, Artificial Sequence
  primer
aaaaggcctacacaaaccttgctccaacag

SEQ ID NO: 6251 - DNA, 31 bp, Artificial Sequence
  primer
aaaggtacctcaatatgccactctcaagctc

SEQ ID NO: 6252 - DNA, 31 bp, Artificial Sequence
  primer
aaaggtaccaactgagcaccctcagtgaaag

SEQ ID NO: 6253 - DNA, 31 bp, Artificial Sequence
  primer
aaagaattcgacggagggagcaatatgtatg

SEQ ID NO: 6254 - DNA, 34 bp, Artificial Sequence
  primer
aaaggtacccattgaaacaattacagtggacaga

SEQ ID NO: 6255 - DNA, 31 bp, Artificial Sequence
  primer
aaaggtaccttagcatttggtgacagagacg

SEQ ID NO: 6256 - DNA, 35 bp, Artificial Sequence
  primer
tttggtaccgaatttaaggagaataagcacacttg

SEQ ID NO: 6257 - DNA, 39 bp, Artificial Sequence
  primer
tttggatccttaacattatttcttgagaaggtgactttc

SEQ ID NO: 6258 - DNA, 31 bp, Artificial Sequence
  primer
aaaggtaccccatagcttgagagaagacctg

SEQ ID NO: 6259 - DNA, 31 bp, Artificial Sequence
  primer
aaaggtacccaacaatctctgcatcagttgg

SEQ ID NO: 6260 - DNA, 34 bp, Artificial Sequence
  primer
aaaggtacctgttgtaacaattctagcaaccaaa

SEQ ID NO: 6261 - DNA, 31 bp, Artificial Sequence
  primer
aaaggtaccgggattaaggcgaagttattgg

SEQ ID NO: 6262 - DNA, 31 bp, Artificial Sequence
  primer
aaaggtacccgatgattaaccgcagatcaac

SEQ ID NO: 6263 - DNA, 31 bp, Artificial Sequence
  primer
aaaggtacctaatggaaaaggacgaccagac

SEQ ID NO: 6264 - DNA, 31 bp, Artificial Sequence
  primer
aaagatatcgctataaatccagtgcccagag

SEQ ID NO: 6265 - DNA, 31 bp, Artificial Sequence
  primer
aaaaggcctgatgatacacaccaaatgcagc

SEQ ID NO: 6266 - DNA, 37 bp, Artificial Sequence
  primer
tttgaattctcacagcgatgatattgtagctctactg

SEQ ID NO: 6267 - DNA, 32 bp, Artificial Sequence
  primer
aaaaggcctgatttgcatttgcaatgtgttac

SEQ ID NO: 6268 - DNA, 32 bp, Artificial Sequence
  primer
tttgaattcttaagcgactaccaacacaggga

SEQ ID NO: 6269 - DNA, 35 bp, Artificial Sequence
  primer
aaaggatccattagaagacatgaagaacggtaacc

SEQ ID NO: 6270 - DNA, 31 bp, Artificial Sequence
  primer
aaaggatccaatctggttgaggaaagctgac

SEQ ID NO: 6271 - DNA, 34 bp, Artificial Sequence
  primer
aaaggatccgaagaagatatttgttgctgatggc

SEQ ID NO: 6272 - DNA, 32 bp, Artificial Sequence
  primer
aaaggatccaaaagatggagagaagcttgaag

SEQ ID NO: 6273 - DNA, 29 bp, Artificial Sequence
  primer
aaactcgagcgaaaccctagcctcatctc

SEQ ID NO: 6274 - DNA, 28 bp, Artificial Sequence
  primer
aaagtcgacagatctcccaagggccaag

SEQ ID NO: 6275 - DNA, 31 bp, Artificial Sequence
  primer
aaaggatcctgctcttcgtctgatcaatctc

SEQ ID NO: 6276 - DNA, 30 bp, Artificial Sequence
  primer
aaaggatccactctcctagctcaggccaag

SEQ ID NO: 6277 - DNA, 29 bp, Artificial Sequence
  primer
aaaggatccgagagcagaagccactccag

SEQ ID NO: 6278 - DNA, 28 bp, Artificial Sequence
  primer
aaaggatccttagccgtctccgacttcc

SEQ ID NO: 6279 - DNA, 31 bp, Artificial Sequence
  primer
aaactcgagactgatgctcgtggagagattc

SEQ ID NO: 6280 - DNA, 27 bp, Artificial Sequence
  primer
aaaggatccagaggagctcccaccagc

SEQ ID NO: 6281 - DNA, 29 bp, Artificial Sequence
  primer
aaaggatccccagacaggcagacagacag

SEQ ID NO: 6282 - DNA, 28 bp, Artificial Sequence
  primer
aatggatccaccgcgatgtatcctctgg

SEQ ID NO: 6283 - DNA, 31 bp, Artificial Sequence
  primer
aaaggatccatacgcccacactcactacttg

SEQ ID NO: 6284 - DNA, 31 bp, Artificial Sequence
  primer
aaactcgaggttcgctactggcaacattcac

SEQ ID NO: 6285 - DNA, 31 bp, Artificial Sequence
  primer
aaaggatccaacgcttatcaccatccctttc

SEQ ID NO: 6286 - DNA, 32 bp, Artificial Sequence
  primer
aaagtcgaccaagtggcagcagtagatagagc

SEQ ID NO: 6287 - DNA, 31 bp, Artificial Sequence
  primer
aaaggatccctgcatcttcttcttccaatcc

SEQ ID NO: 6288 - DNA, 26 bp, Artificial Sequence
  primer
tttgaattcattcggcgacgctgctc

SEQ ID NO: 6289 - DNA, 27 bp, Artificial Sequence
  primer
aaaggatccttctctgaccccgagacc

SEQ ID NO: 6290 - DNA, 31 bp, Artificial Sequence
  primer
aaaggatcctacccaatcacggatctctagc

SEQ ID NO: 6291 - DNA, 31 bp, Artificial Sequence
  primer
aaactcgagcgtgaagaaacacacaagaagg

SEQ ID NO: 6292 - DNA, 27 bp, Artificial Sequence
  primer
aaaggatccaggccgatgcccccaatg

SEQ ID NO: 6293 - DNA, 31 bp, Artificial Sequence
  primer
aaagtcgacgacaaccatctgactaagcagc

SEQ ID NO: 6294 - DNA, 31 bp, Artificial Sequence
  primer
aaagtcgacttccatttctgttggaggtttg

SEQ ID NO: 6295 - DNA, 30 bp, Artificial Sequence
  primer
aaaggatcctagcagaatccacccgctatc

SEQ ID NO: 6296 - DNA, 26 bp, Artificial Sequence
  primer
aaagaattccgaaaatgtcgcctccg

SEQ ID NO: 6297 - DNA, 28 bp, Artificial Sequence
  primer
aaaggatccctggatcgacgatgatgtg

SEQ ID NO: 6298 - DNA, 31 bp, Artificial Sequence
  primer
aaaggatccccaagcctaagaaaccacacag

SEQ ID NO: 6299 - DNA, 27 bp, Artificial Sequence
  primer
aaaggatccctaggcctcgaatggcgt

SEQ ID NO: 6300 - DNA, 29 bp, Artificial Sequence
  primer
aaaggatcctcagaaatcctacccggagc

SEQ ID NO: 6301 - DNA, 30 bp, Artificial Sequence
  primer
aaagtcgacagaaaccctagccacagcaag

SEQ ID NO: 6302 - DNA, 28 bp, Artificial Sequence
  primer
aaaggatccaattgcctgccaactccac

SEQ ID NO: 6303 - DNA, 29 bp, Artificial Sequence
  primer
aaaggatccagcaaggaagggagatccac

SEQ ID NO: 6304 - DNA, 29 bp, Artificial Sequence
  primer
aaactcgaggacacgtccatcctccactc

SEQ ID NO: 6305 - DNA, 30 bp, Artificial Sequence
  primer
aaaggatccgagagagggagaaagaggcac

SEQ ID NO: 6306 - DNA, 29 bp, Artificial Sequence
  primer
aaggatccactacttccgggaactcttgc

SEQ ID NO: 6307 - DNA, 27 bp, Artificial Sequence
  primer
aaaggatccatttgcgtggattccgtg

SEQ ID NO: 6308 - DNA, 28 bp, Artificial Sequence
  primer
aaagtcgacaacgtttggtggatggagg

SEQ ID NO: 6309 - DNA, 28 bp, Artificial Sequence
  primer
aaaggatccacctcaccctcaccctcac

SEQ ID NO: 6310 - DNA, 27 bp, Artificial Sequence
  primer
aaagtcgacgcaggatgaaggccaagg

SEQ ID NO: 6311 - DNA, 30 bp, Artificial Sequence
  primer
aaaggatccatcgtgcctactccctctctc

SEQ ID NO: 6312 - DNA, 27 bp, Artificial Sequence
  primer
aaaggatccgctagcgagcaatggacc

SEQ ID NO: 6313 - DNA, 31 bp, Artificial Sequence
  primer
aaagtcgacactttgatcttgggattggttg

SEQ ID NO: 6314 - DNA, 27 bp, Artificial Sequence
  primer
aaaggatccacggccatgaagcgcttc

SEQ ID NO: 6315 - DNA, 26 bp, Artificial Sequence
  primer
aaagtcgacggaaaatggaggccacc

SEQ ID NO: 6316 - DNA, 31 bp, Artificial Sequence
  primer
aaaggatccgctttattgaccattgtcgctc

SEQ ID NO: 6317 - DNA, 28 bp, Artificial Sequence
  primer
aaaggatccgcacaagcgaagtgagagc

SEQ ID NO: 6318 - DNA, 28 bp, Artificial Sequence
  primer
aaaggatccagctctctcctcgcaatgg

SEQ ID NO: 6319 - DNA, 29 bp, Artificial Sequence
  primer
aaagtcgacgaaatatccccaaaccctcg

SEQ ID NO: 6320 - DNA, 30 bp, Artificial Sequence
  primer
tttgatatcctttgagatcatgggagggtc

SEQ ID NO: 6321 - DNA, 30 bp, Artificial Sequence
  primer
aaaggatccctgaaagggcggtgaagttag

SEQ ID NO: 6322 - DNA, 30 bp, Artificial Sequence
  primer
aaagtcgacggtgaaatgaagtcaacggtg

SEQ ID NO: 6323 - DNA, 29 bp, Artificial Sequence
  primer
aaagtcgacaggaggccatcaaatcacag

SEQ ID NO: 6324 - DNA, 33 bp, Artificial Sequence
  primer
aaaggatccgagaatagtagcgtgagaacgagg

SEQ ID NO: 6325 - DNA, 31 bp, Artificial Sequence
  primer
aaaggatcccacgtagtctcccactctcctc

SEQ ID NO: 6326 - DNA, 31 bp, Artificial Sequence
  primer
aaaggatccgctgccttatcctctgctactg

SEQ ID NO: 6327 - DNA, 33 bp, Artificial Sequence
  primer
aaagtcgacgggtactgtagagagaccgggtag

SEQ ID NO: 6328 - DNA, 30 bp, Artificial Sequence
  primer
aaaggatccaagcagcctggtttacggtag

SEQ ID NO: 6329 - DNA, 36 bp, Artificial Sequence
  primer
aaaggatccactgtatttttctctcctcactcaacg

SEQ ID NO: 6330 - DNA, 31 bp, Artificial Sequence
  primer
aaagtcgactcagtagtggatagctccgctc

SEQ ID NO: 6331 - DNA, 30 bp, Artificial Sequence
  primer
aaaggatccagaatgggttgggaattatgc

SEQ ID NO: 6332 - DNA, 28 bp, Artificial Sequence
  primer
aaaggatcccgccatctttagcctggac

SEQ ID NO: 6333 - DNA, 27 bp, Artificial Sequence
  primer
aaaggatccgcctctgctctgctcgtc

SEQ ID NO: 6334 - DNA, 31 bp, Artificial Sequence
  primer
aaaggatccgatgatgctgatgctcgtttag

SEQ ID NO: 6335 - DNA, 30 bp, Artificial Sequence
  primer
aaaggatccctggtcatccattccacacac

SEQ ID NO: 6336 - DNA, 28 bp, Artificial Sequence
  primer
aaactcgaggaattgcgatcatccgttc

SEQ ID NO: 6337 - DNA, 28 bp, Artificial Sequence
  primer
aaagtcgaccgaatcctgcctagccttc

SEQ ID NO: 6338 - DNA, 32 bp, Artificial Sequence
  primer
aaaggatccagaaacttccgtgtgtaggtgac

SEQ ID NO: 6339 - DNA, 27 bp, Artificial Sequence
  primer
tttggatccccttgctcattggctagg

SEQ ID NO: 6340 - DNA, 28 bp, Artificial Sequence
  primer
aaaggatcctggctgtctcggtgtcatc

SEQ ID NO: 6341 - DNA, 31 bp, Artificial Sequence
  primer
aaaggatccgaagcagcagcaggtaaagaac

SEQ ID NO: 6342 - DNA, 31 bp, Artificial Sequence
  primer
aaacccggggttagatcggctgtgcttgttc

SEQ ID NO: 6343 - DNA, 31 bp, Artificial Sequence
  primer
aaaggatcctggtggtcttcttgttcaatcc

SEQ ID NO: 6344 - DNA, 31 bp, Artificial Sequence
  primer
aaaggatccaccaatctttctgtccgatcac

SEQ ID NO: 6345 - DNA, 27 bp, Artificial Sequence
  primer
aaaggatccgacgacgacgacgacgac

SEQ ID NO: 6346 - DNA, 31 bp, Artificial Sequence
  primer
aaaggatccacagcacatctgtttagccaag

SEQ ID NO: 6347 - DNA, 31 bp, Artificial Sequence
  primer
aaagtcgaccactcaaatccactgtgactcc

SEQ ID NO: 6348 - DNA, 29 bp, Artificial Sequence
  primer
aaaggatccccgaagatccaggttgagtc

SEQ ID NO: 6349 - DNA, 31 bp, Artificial Sequence
  primer
aaaggatccctgatcgaagtgaacaagcaag

SEQ ID NO: 6350 - DNA, 31 bp, Artificial Sequence
  primer
aaaggatcctcgttggcttcaaatactggtc

SEQ ID NO: 6351 - DNA, 31 bp, Artificial Sequence
  primer
aaagtcgaccaagatcttaacgaccctcacg

SEQ ID NO: 6352 - DNA, 36 bp, Artificial Sequence
  primer
aaaggatccaaacattggtatatacagtgcggatag

SEQ ID NO: 6353 - DNA, 26 bp, Artificial Sequence
  primer
aaaggatccgatcgatggaggcgagg

SEQ ID NO: 6354 - DNA, 31 bp, Artificial Sequence
  primer
aaaggatccaagctcataatcgacacacacc

SEQ ID NO: 6355 - DNA, 30 bp, Artificial Sequence
  primer
aaacccgggcatcctctctcctccagtgac

SEQ ID NO: 6356 - DNA, 31 bp, Artificial Sequence
  primer
aaaggatccgtccgcagtctctcttccctac

SEQ ID NO: 6357 - DNA, 30 bp, Artificial Sequence
  primer
aaaggatccactcatctcatcaccgctttc

SEQ ID NO: 6358 - DNA, 31 bp, Artificial Sequence
  primer
aaagtcgacagaaacagcaaagatccagtgc

SEQ ID NO: 6359 - DNA, 34 bp, Artificial Sequence
  primer
aaactcgaggagtgtctccagtctcaagtacagc

SEQ ID NO: 6360 - DNA, 31 bp, Artificial Sequence
  primer
aaaggatccagcatactgtcaggctaccagc

SEQ ID NO: 6361 - DNA, 30 bp, Artificial Sequence
  primer
aaaggatccaccgacccacctctctcatag

SEQ ID NO: 6362 - DNA, 29 bp, Artificial Sequence
  primer
aaaggatcccagaggcagttgtgttgctg

SEQ ID NO: 6363 - DNA, 28 bp, Artificial Sequence
  primer
aaaggatccgagcaacgatgttcaggtg

SEQ ID NO: 6364 - DNA, 30 bp, Artificial Sequence
  primer
aaaggatccgacattccaatcagttccctg

SEQ ID NO: 6365 - DNA, 29 bp, Artificial Sequence
  primer
aaaggatccctatatcctcccgcaccctc

SEQ ID NO: 6366 - DNA, 27 bp, Artificial Sequence
  primer
aaaggatcccaggagctctcgatggtg

SEQ ID NO: 6367 - DNA, 30 bp, Artificial Sequence
  primer
aaagtcgacgccgagaagaagctaaggctc

SEQ ID NO: 6368 - DNA, 30 bp, Artificial Sequence
  primer
aaaggatccctgctcgggctagattaggag

SEQ ID NO: 6369 - DNA, 31 bp, Artificial Sequence
  primer
aaagtcgacatcgagacagagttccacgaag

SEQ ID NO: 6370 - DNA, 31 bp, Artificial Sequence
  primer
aaaggatccgctccgacgaaccctaataatc

SEQ ID NO: 6371 - DNA, 31 bp, Artificial Sequence
  primer
aaaggatcctgagttgacatgccgttagttg

SEQ ID NO: 6372 - DNA, 31 bp, Artificial Sequence
  primer
aaaggatccgccttgtcgtcatagaacaacc

SEQ ID NO: 6373 - DNA, 28 bp, Artificial Sequence
  primer
aaaggatccagattggattagcgccgag

SEQ ID NO: 6374 - DNA, 31 bp, Artificial Sequence
  primer
aaagtcgacagtcttgtatcacccgcatctg

SEQ ID NO: 6375 - DNA, 31 bp, Artificial Sequence
  primer
aaaggatccggtcaaagtttgggagacagag

SEQ ID NO: 6376 - DNA, 35 bp, Artificial Sequence
  primer
aaaggatccggtagtagatctttcgtacgttggag

SEQ ID NO: 6377 - DNA, 26 bp, Artificial Sequence
  primer
aaagtcgaccggagatgagcgggagc

SEQ ID NO: 6378 - DNA, 27 bp, Artificial Sequence
  primer
aaaggatcctgacaacgccttcccaac

SEQ ID NO: 6379 - DNA, 28 bp, Artificial Sequence
  primer
aaagtcgacgccattatccgaacccaag

SEQ ID NO: 6380 - DNA, 26 bp, Artificial Sequence
  primer
aaaggatccaatgccatgcgtgtgtg

SEQ ID NO: 6381 - DNA, 31 bp, Artificial Sequence
  primer
aaagtcgacagctagctgccttcatctatcg

SEQ ID NO: 6382 - DNA, 31 bp, Artificial Sequence
  primer
aaaggatccacgtttctggaagttcgttgag

SEQ ID NO: 6383 - DNA, 27 bp, Artificial Sequence
  primer
aaactcgagaccgttgcttcttcctgc

SEQ ID NO: 6384 - DNA, 31 bp, Artificial Sequence
  primer
aaaggatccgaagagataagcccgggtaaag

SEQ ID NO: 6385 - DNA, 31 bp, Artificial Sequence
  primer
aaaggatccgacaagaggtggaggagcatac

SEQ ID NO: 6386 - DNA, 29 bp, Artificial Sequence
  primer
aaaggatcccaggaatagcgcaacgagac

SEQ ID NO: 6387 - DNA, 26 bp, Artificial Sequence
  primer
aaagtcgacgagccatgccaaactgg

SEQ ID NO: 6388 - DNA, 31 bp, Artificial Sequence
  primer
aaaggatccgtcttcctgcttgaggtttctg

SEQ ID NO: 6389 - DNA, 26 bp, Artificial Sequence
  primer
aaagtcgacctcccatggccaacctc

SEQ ID NO: 6390 - DNA, 28 bp, Artificial Sequence
  primer
aaaggatccgacgctcttcctcctcctc

SEQ ID NO: 6391 - DNA, 31 bp, Artificial Sequence
  primer
aaaggatccaaaggccacctaccttaaccag

SEQ ID NO: 6392 - DNA, 28 bp, Artificial Sequence
  primer
aaagtcgacgattgccgctctgttcttg

SEQ ID NO: 6393 - DNA, 27 bp, Artificial Sequence
  primer
aaagtcgacgggccaagacagatggtg

SEQ ID NO: 6394 - DNA, 29 bp, Artificial Sequence
  primer
aaaggatccctcactccctgtctgccatc

SEQ ID NO: 6395 - DNA, 29 bp, Artificial Sequence
  primer
aaaggatccctagcatcgtagccagccag

SEQ ID NO: 6396 - DNA, 27 bp, Artificial Sequence
  primer
aaaggatccgcaaccaaggcaaaccag

SEQ ID NO: 6397 - DNA, 31 bp, Artificial Sequence
  primer
aaagaattcagaaggaagctcatcaatctcg

SEQ ID NO: 6398 - DNA, 31 bp, Artificial Sequence
  primer
aaaggatccaagacggtagcaaggagaaatg

SEQ ID NO: 6399 - DNA, 31 bp, Artificial Sequence
  primer
aaagaattcttcccacgtaacgttaatctcc

SEQ ID NO: 6400 - DNA, 28 bp, Artificial Sequence
  primer
aaaggatccgccttcccttgtcgaagtc

SEQ ID NO: 6401 - DNA, 31 bp, Artificial Sequence
  primer
aaaggatccaggcatatgttgtgatttgtcg

SEQ ID NO: 6402 - DNA, 31 bp, Artificial Sequence
  primer
aaaggatccataaaccacgcacactcctctc

SEQ ID NO: 6403 - DNA, 28 bp, Artificial Sequence
  primer
aaagagctcacttccagggagggaaacc

SEQ ID NO: 6404 - DNA, 31 bp, Artificial Sequence
  primer
aaaggatccttgctttgcctctcctagactc

SEQ ID NO: 6405 - DNA, 31 bp, Artificial Sequence
  primer
aaagatatccactcctacgctacctacctgc

SEQ ID NO: 6406 - DNA, 30 bp, Artificial Sequence
  primer
aaaggatcccatccttcctccagactccag

SEQ ID NO: 6407 - DNA, 31 bp, Artificial Sequence
  primer
aaagtcgacctactaatccaaattggcgacg

SEQ ID NO: 6408 - DNA, 31 bp, Artificial Sequence
  primer
aaaggatccgtctgctgggaagtggactaag

SEQ ID NO: 6409 - DNA, 29 bp, Artificial Sequence
  primer
aaagtcgacactgccaagtgctcaacacc

SEQ ID NO: 6410 - DNA, 27 bp, Artificial Sequence
  primer
aaaggatcccaaggcctcctcctcctc

SEQ ID NO: 6411 - DNA, 31 bp, Artificial Sequence
  primer
aaaggatccgcattcaacactcatcaacagc

SEQ ID NO: 6412 - DNA, 33 bp, Artificial Sequence
  primer
aaaggatccctctcgcttactagaaggtccaag

SEQ ID NO: 6413 - DNA, 31 bp, Artificial Sequence
  primer
aaggatcctacgatctttctgtgggagtttg

SEQ ID NO: 6414 - DNA, 32 bp, Artificial Sequence
  primer
aaaggatccctttcttgatcgaattgaagcag

SEQ ID NO: 6415 - DNA, 27 bp, Artificial Sequence
  primer
aaaggatccgcaatcgcaacacccaag

SEQ ID NO: 6416 - DNA, 28 bp, Artificial Sequence
  primer
aaaggatcccgagagatggagaagcagg

SEQ ID NO: 6417 - DNA, 31 bp, Artificial Sequence
  primer
aaaggatcctgtataaatcggcctttgcttc

SEQ ID NO: 6418 - DNA, 31 bp, Artificial Sequence
  primer
aaaggatccgcgttgctgtagtaagcttgtg

SEQ ID NO: 6419 - DNA, 30 bp, Artificial Sequence
  primer
aaaggatcccgcttgctgaatcaggagtag

SEQ ID NO: 6420 - DNA, 27 bp, Artificial Sequence
  primer
aaaggatccaaggaagcggcagtggag

SEQ ID NO: 6421 - DNA, 27 bp, Artificial Sequence
  primer
aaaggatccgagagatggggaggcagc

SEQ ID NO: 6422 - DNA, 31 bp, Artificial Sequence
  primer
aaagtcgacccagtcgaggcagtacaagttc

SEQ ID NO: 6423 - DNA, 31 bp, Artificial Sequence
  primer
aaaggatccaaactgatcatcgaggagatcg

SEQ ID NO: 6424 - DNA, 29 bp, Artificial Sequence
  primer
aaaggatccgaggtgaggtttgcagcttg

SEQ ID NO: 6425 - DNA, 31 bp, Artificial Sequence
  primer
aaaggatccgtagagatcaccttcgcctcac

SEQ ID NO: 6426 - DNA, 28 bp, Artificial Sequence
  primer
aaaggatcccacagcggtttcactgctc

SEQ ID NO: 6427 - DNA, 26 bp, Artificial Sequence
  primer
aaagtcgactccccaccctatccctc

SEQ ID NO: 6428 - DNA, 31 bp, Artificial Sequence
  primer
aaagtcgacactgtgtttggaaatgtgcatc

SEQ ID NO: 6429 - DNA, 32 bp, Artificial Sequence
  primer
aaaggatcccagaagatgaagcagtgtagtgg

SEQ ID NO: 6430 - DNA, 35 bp, Artificial Sequence
  primer
aaagtcgacggagaagagagtgccttgtaataatc

SEQ ID NO: 6431 - DNA, 32 bp, Artificial Sequence
  primer
aaaggatccgtgagtgtaaaaatggtgcaacc

SEQ ID NO: 6432 - DNA, 34 bp, Artificial Sequence
  primer
aaagtcgactgatcaaacagaagaagagtgagtg

SEQ ID NO: 6433 - DNA, 32 bp, Artificial Sequence
  primer
aaaggatccccaagaatcaaactttaacaacc

SEQ ID NO: 6434 - DNA, 32 bp, Artificial Sequence
  primer
aaaaggcctaacccagatctacggttgaaatc

SEQ ID NO: 6435 - DNA, 35 bp, Artificial Sequence
  primer
aaaggatcctggaatagttgaagaagaagaagagg

SEQ ID NO: 6436 - DNA, 31 bp, Artificial Sequence
  primer
aaagatatcgcttaatttggacctgcatttg

SEQ ID NO: 6437 - DNA, 28 bp, Artificial Sequence
  primer
aaagtcgacacaacatggcactcaccac

SEQ ID NO: 6438 - DNA, 32 bp, Artificial Sequence
  primer
aaaggatccaagaagggtctgaagaaatcacc

SEQ ID NO: 6439 - DNA, 33 bp, Artificial Sequence
  primer
aaaggatcccaacaaacaaacagcaatcttctc

SEQ ID NO: 6440 - DNA, 31 bp, Artificial Sequence
  primer
aaagtcgacgctccaatctccattagagacc

SEQ ID NO: 6441 - DNA, 31 bp, Artificial Sequence
  primer
aaagtcgacgtggcctagcaaggacatacac

SEQ ID NO: 6442 - DNA, 36 bp, Artificial Sequence
  primer
aaaggatcccgtaagattttcaacagtagaagagtg

SEQ ID NO: 6443 - DNA, 34 bp, Artificial Sequence
  primer
aaaggatcctggataagatggatacacaaattcc

SEQ ID NO: 6444 - DNA, 31 bp, Artificial Sequence
  primer
aaagtcgaccaccgcgaaactaactgaactc

SEQ ID NO: 6445 - DNA, 31 bp, Artificial Sequence
  primer
aaaggatccatagtctgtcgtgccgtgttag

SEQ ID NO: 6446 - DNA, 36 bp, Artificial Sequence
  primer
aaagtcgacaaaggtcttctacttcaacatgtcaac

SEQ ID NO: 6447 - DNA, 36 bp, Artificial Sequence
  primer
aaaggatcccacatatataagaagttgctatggcct

SEQ ID NO: 6448 - DNA, 34 bp, Artificial Sequence
  primer
aaaggatcctctctcatctgtgtgtgtagaaagc

SEQ ID NO: 6449 - DNA, 28 bp, Artificial Sequence
  primer
aaaggatcctggctatggcttttcaagg

SEQ ID NO: 6450 - DNA, 36 bp, Artificial Sequence
  primer
aaagtcgacaaaatatgggtttaaaaggtaagttga

SEQ ID NO: 6451 - DNA, 32 bp, Artificial Sequence
  primer
aaaggatcccattccatttccatcatactacc

SEQ ID NO: 6452 - DNA, 31 bp, Artificial Sequence
  primer
aaaggatccttatctctgttgctgtgggaag

SEQ ID NO: 6453 - DNA, 31 bp, Artificial Sequence
  primer
aaaggatcccaacccacatcaagattcatca

SEQ ID NO: 6454 - DNA, 31 bp, Artificial Sequence
  primer
aaaggatccggttcaaagaggagatcgtcac

SEQ ID NO: 6455 - DNA, 31 bp, Artificial Sequence
  primer
aaaggatcctcagaaattctcttgctccgac

SEQ ID NO: 6456 - DNA, 31 bp, Artificial Sequence
  primer
aaagtcgacctgctccgtctgaatcttcttc

SEQ ID NO: 6457 - DNA, 30 bp, Artificial Sequence
  primer
aaagaattctcgcagtttcatcacaaatcc

SEQ ID NO: 6458 - DNA, 28 bp, Artificial Sequence
  primer
aaagatatctagagagggaggcgacgag

SEQ ID NO: 6459 - DNA, 31 bp, Artificial Sequence
  primer
aaagaattccaagaaatccacagaaaccgag

SEQ ID NO: 6460 - DNA, 27 bp, Artificial Sequence
  primer
aaactcgagcacgcaaacccaacgaac

SEQ ID NO: 6461 - DNA, 35 bp, Artificial Sequence
  primer
tttggtaccttactagaagcccataaatttgagcc

SEQ ID NO: 6462 - DNA, 32 bp, Artificial Sequence
  primer
aaaggtaccttcagattgttgacatcttcacc

SEQ ID NO: 6463 - DNA, 32 bp, Artificial Sequence
  primer
aaaggtacctcaaaactataaagcagcaaagc

SEQ ID NO: 6464 - DNA, 29 bp, Artificial Sequence
  primer
aaagaattctggtcacctcgctcttgaac

SEQ ID NO: 6465 - DNA, 33 bp, Artificial Sequence
  primer
aaaggtaccctaattccttcgtgcacattcaag

SEQ ID NO: 6466 - DNA, 31 bp, Artificial Sequence
  primer
aaaggtaccccacattccttattgcacacac

SEQ ID NO: 6467 - DNA, 34 bp, Artificial Sequence
  primer
aaaggtaccctaaacatacaagacagccagatgc

SEQ ID NO: 6468 - DNA, 31 bp, Artificial Sequence
  primer
aaaggtaccttatgcaccctgtcttgatctg

SEQ ID NO: 6469 - DNA, 31 bp, Artificial Sequence
  primer
aaaggtacctcacaggtgtctaacgaggatg

SEQ ID NO: 6470 - DNA, 31 bp, Artificial Sequence
  primer
aaaggtaccgaagcaacacaaagtgcatacg

SEQ ID NO: 6471 - DNA, 31 bp, Artificial Sequence
  primer
aaagaattccgcctttgtgcatactatcatc

SEQ ID NO: 6472 - DNA, 31 bp, Artificial Sequence
  primer
aaaggtaccgtatgtacgtgtccgctacgtg

SEQ ID NO: 6473 - DNA, 31 bp, Artificial Sequence
  primer
aaaggtacctcatcacaccttcagcagtttc

SEQ ID NO: 6474 - DNA, 33 bp, Artificial Sequence
  primer
aaaggtaccctactgtgcaacactgcttcttcc

SEQ ID NO: 6475 - DNA, 34 bp, Artificial Sequence
  primer
aaagaattcctattggaagtgtgcagtgaatttg

SEQ ID NO: 6476 - DNA, 31 bp, Artificial Sequence
  primer
aaagaattccaaactcatcagcatcatgtcc

SEQ ID NO: 6477 - DNA, 31 bp, Artificial Sequence
  primer
aaaggatcccaagcaccacactcgatacttc

SEQ ID NO: 6478 - DNA, 31 bp, Artificial Sequence
  primer
aaaggtacccacgcccaatcaagatctattc

SEQ ID NO: 6479 - DNA, 30 bp, Artificial Sequence
  primer
tttaggcctttatcatgcgtccacagcaac

SEQ ID NO: 6480 - DNA, 32 bp, Artificial Sequence
  primer
aaaggtaccccacgagcaaatcttagctactc

SEQ ID NO: 6481 - DNA, 34 bp, Artificial Sequence
  primer
aaaggtaccctacagatagtcacccaaccgtaca

SEQ ID NO: 6482 - DNA, 31 bp, Artificial Sequence
  primer
aaaggtacccaacttgcagataacatggtgc

SEQ ID NO: 6483 - DNA, 31 bp, Artificial Sequence
  primer
aaagaattctctcagcaggaatcacacagac

SEQ ID NO: 6484 - DNA, 35 bp, Artificial Sequence
  primer
aaaggtacccagtcagatgaactcacaccataatc

SEQ ID NO: 6485 - DNA, 36 bp, Artificial Sequence
  primer
aaaggtaccctattcatttccgtattcttgagaagg

SEQ ID NO: 6486 - DNA, 31 bp, Artificial Sequence
  primer
aaaaggcctacgcactgcccttctagttatg

SEQ ID NO: 6487 - DNA, 31 bp, Artificial Sequence
  primer
aaagaattcgatttcgaatggcacgacttac

SEQ ID NO: 6488 - DNA, 32 bp, Artificial Sequence
  primer
aaaggtaccgcagtttaacccggagaacttac

SEQ ID NO: 6489 - DNA, 31 bp, Artificial Sequence
  primer
aaaggtacctagatcgagtttcaatggctcc

SEQ ID NO: 6490 - DNA, 31 bp, Artificial Sequence
  primer
aaaggatcccatagaggcaaggctgaagaac

SEQ ID NO: 6491 - DNA, 33 bp, Artificial Sequence
  primer
tttggtaccttagaaaatttcccatccatgacg

SEQ ID NO: 6492 - DNA, 31 bp, Artificial Sequence
  primer
tttgaattcttacgttccagagaccaccctc

SEQ ID NO: 6493 - DNA, 33 bp, Artificial Sequence
  primer
tttggtaccttaacagtttgctcatgtggtctg

SEQ ID NO: 6494 - DNA, 31 bp, Artificial Sequence
  primer
aaaggatcccagcaaatctttggtcattcag

SEQ ID NO: 6495 - DNA, 35 bp, Artificial Sequence
  primer
tttggtaccttatagaagttagccggagctcttcg

SEQ ID NO: 6496 - DNA, 32 bp, Artificial Sequence
  primer
tttgaattcttacacaactcaaggcctactgg

SEQ ID NO: 6497 - DNA, 34 bp, Artificial Sequence
  primer
aaaggtaccctaggcaggtagtacttgggaacag

SEQ ID NO: 6498 - DNA, 31 bp, Artificial Sequence
  primer
aaaggtaccacacgcataggcaagatgagtc

SEQ ID NO: 6499 - DNA, 31 bp, Artificial Sequence
  primer
aaagaattcccatacaaactcaacggaatgc

SEQ ID NO: 6500 - DNA, 31 bp, Artificial Sequence
  primer
aaaggtacccaggcggagtctagacagtagg

SEQ ID NO: 6501 - DNA, 31 bp, Artificial Sequence
  primer
aaagaattctacacacatcatccatcagcag

SEQ ID NO: 6502 - DNA, 31 bp, Artificial Sequence
  primer
aaagaattcaaatcactgacgcattcctctc

SEQ ID NO: 6503 - DNA, 34 bp, Artificial Sequence
  primer
aaaggtaccctaaccgaaactcacgaattgaaag

SEQ ID NO: 6504 - DNA, 31 bp, Artificial Sequence
  primer
aaaggtaccagcctgtggccagttaaattac

SEQ ID NO: 6505 - DNA, 31 bp, Artificial Sequence
  primer
aaaggtacctacaattagctcccgattcctg

SEQ ID NO: 6506 - DNA, 31 bp, Artificial Sequence
  primer
aaaaggcctggctcaagttcaggtgtgtagg

SEQ ID NO: 6507 - DNA, 31 bp, Artificial Sequence
  primer
aaaggtacccctacatcaagtcaagccgaac

SEQ ID NO: 6508 - DNA, 31 bp, Artificial Sequence
  primer
aaaggtaccgcacgcaggtctatttagatgc

SEQ ID NO: 6509 - DNA, 32 bp, Artificial Sequence
  primer
aaaggatccctaccctagcagttggtttccag

SEQ ID NO: 6510 - DNA, 31 bp, Artificial Sequence
  primer
aaaggtaccgcctaacggacattggttattc

SEQ ID NO: 6511 - DNA, 31 bp, Artificial Sequence
  primer
aaagaattctggtgtcgaagacagatgaaag

SEQ ID NO: 6512 - DNA, 31 bp, Artificial Sequence
  primer
aaaggtaccgagtctcaactctcaagcgcac

SEQ ID NO: 6513 - DNA, 35 bp, Artificial Sequence
  primer
aaaaggcctctaccattgaaccaaagttacagcag

SEQ ID NO: 6514 - DNA, 31 bp, Artificial Sequence
  primer
aaaggtaccgccaaatcgcctctttagattc

SEQ ID NO: 6515 - DNA, 29 bp, Artificial Sequence
  primer
aaagaattctcacagctcgatccatcaac

SEQ ID NO: 6516 - DNA, 30 bp, Artificial Sequence
  primer
aaaggatccgtttcatggtgatacccggag

SEQ ID NO: 6517 - DNA, 31 bp, Artificial Sequence
  primer
aaaggtaccaagaaagaatcggtgtcgtgtc

SEQ ID NO: 6518 - DNA, 31 bp, Artificial Sequence
  primer
aaactcgagaacttgttgacatcattgcacg

SEQ ID NO: 6519 - DNA, 31 bp, Artificial Sequence
  primer
aaagatatccaaatggtggttgtcacttgtc

SEQ ID NO: 6520 - DNA, 36 bp, Artificial Sequence
  primer
tttgaattcttatgctgccgagttactagttagagg

SEQ ID NO: 6521 - DNA, 31 bp, Artificial Sequence
  primer
aaagaattcacagaactagttaaccgccgag

SEQ ID NO: 6522 - DNA, 35 bp, Artificial Sequence
  primer
aaaggtaccctatttcaccgaatgaatatgacagg

SEQ ID NO: 6523 - DNA, 33 bp, Artificial Sequence
  primer
aaaggtaccctaaggagctgcgtcgtttatttg

SEQ ID NO: 6524 - DNA, 31 bp, Artificial Sequence
  primer
aaaggtaccttcttccaactaatgccaggac

SEQ ID NO: 6525 - DNA, 31 bp, Artificial Sequence
  primer
aaagaattcaagacatagcaagtaggccacc

SEQ ID NO: 6526 - DNA, 34 bp, Artificial Sequence
  primer
aaaggtaccctatgcagagatcgaacaaagacag

SEQ ID NO: 6527 - DNA, 31 bp, Artificial Sequence
  primer
aaactcgaggcctgcgtatcagtatgttgtg

SEQ ID NO: 6528 - DNA, 31 bp, Artificial Sequence
  primer
aaaggtacccaccttatcttctggcaccaac

SEQ ID NO: 6529 - DNA, 34 bp, Artificial Sequence
  primer
aaagaattcctaagtaagcatttgcagcaacacc

SEQ ID NO: 6530 - DNA, 31 bp, Artificial Sequence
  primer
aaagaattctcactctcagtaatcgcacgac

SEQ ID NO: 6531 - DNA, 34 bp, Artificial Sequence
  primer
aaaggtaccctacgtctgttgaaactgaatgacg

SEQ ID NO: 6532 - DNA, 32 bp, Artificial Sequence
  primer
aaaggtacctcgaagtagataggcaatgcaag

SEQ ID NO: 6533 - DNA, 29 bp, Artificial Sequence
  primer
tttggtaccttagactcgcatcgcatcca

SEQ ID NO: 6534 - DNA, 31 bp, Artificial Sequence
  primer
aaaggtaccctgaagatggtttctcccagtc

SEQ ID NO: 6535 - DNA, 31 bp, Artificial Sequence
  primer
aaaggatccgaagatggtggtacatccaagc

SEQ ID NO: 6536 - DNA, 31 bp, Artificial Sequence
  primer
aaaggtaccagatccgtcaaagtttccacag

SEQ ID NO: 6537 - DNA, 28 bp, Artificial Sequence
  primer
aaaggtacctgggtgcctcatggagtag

SEQ ID NO: 6538 - DNA, 34 bp, Artificial Sequence
  primer
aaaggtaccctaagcatttgagaaaccacggtag

SEQ ID NO: 6539 - DNA, 35 bp, Artificial Sequence
  primer
aaaggtaccctatagcttggaaatcatgagctgtc

SEQ ID NO: 6540 - DNA, 31 bp, Artificial Sequence
  primer
aaaggtaccgatgtcaggacagatcaccatc

SEQ ID NO: 6541 - DNA, 31 bp, Artificial Sequence
  primer
aaaggtaccggatacgactcgactcaagcag

SEQ ID NO: 6542 - DNA, 31 bp, Artificial Sequence
  primer
tttggatccctacaaaggctactgcgcagtg

SEQ ID NO: 6543 - DNA, 31 bp, Artificial Sequence
  primer
aaaggtaccgcacattcagcaaccatatacc

SEQ ID NO: 6544 - DNA, 31 bp, Artificial Sequence
  primer
aaagaattccatccataggccaactcaactc

SEQ ID NO: 6545 - DNA, 31 bp, Artificial Sequence
  primer
aaaggtaccgcacagcacagctaactgaaac

SEQ ID NO: 6546 - DNA, 31 bp, Artificial Sequence
  primer
aaaggatccaatctctctgaacaacgccatc

SEQ ID NO: 6547 - DNA, 34 bp, Artificial Sequence
  primer
aaaggtaccctatgtttcttctccctcttcaagc

SEQ ID NO: 6548 - DNA, 31 bp, Artificial Sequence
  primer
aaagaattccaaccatcggccttacaataac

SEQ ID NO: 6549 - DNA, 31 bp, Artificial Sequence
  primer
aaaggtacctaacagaatcaacaggacgtgg

SEQ ID NO: 6550 - DNA, 31 bp, Artificial Sequence
  primer
aaaggtacccaccgtatcaacatcagcaaag

SEQ ID NO: 6551 - DNA, 31 bp, Artificial Sequence
  primer
aaaggtaccgcttatgtgcacaacaaattgc

SEQ ID NO: 6552 - DNA, 36 bp, Artificial Sequence
  primer
aaaggatccctagctcagagaatgcttggaataaag

SEQ ID NO: 6553 - DNA, 32 bp, Artificial Sequence
  primer
aaaggtacctgagtagattattgcccaccatc

SEQ ID NO: 6554 - DNA, 31 bp, Artificial Sequence
  primer
aaaggtaccatgtacaagctcggatgactcc

SEQ ID NO: 6555 - DNA, 34 bp, Artificial Sequence
  primer
aaaggtaccctaaaggatcaaatagcacaggcac

SEQ ID NO: 6556 - DNA, 31 bp, Artificial Sequence
  primer
aaagaattctatgcatgtcttgctttccatc

SEQ ID NO: 6557 - DNA, 31 bp, Artificial Sequence
  primer
aaagaattcacgcaaccactctccttaaatc

SEQ ID NO: 6558 - DNA, 34 bp, Artificial Sequence
  primer
aaaggtaccctagcttatagaagcatcaccgctc

SEQ ID NO: 6559 - DNA, 31 bp, Artificial Sequence
  primer
aaaggtacctacaacgagccatagccaattc

SEQ ID NO: 6560 - DNA, 31 bp, Artificial Sequence
  primer
aaaggtaccgaagcctaacatcgatctctgc

SEQ ID NO: 6561 - DNA, 31 bp, Artificial Sequence
  primer
aaaaggcctagagatcagctcgtccactttc

SEQ ID NO: 6562 - DNA, 31 bp, Artificial Sequence
  primer
aaaggtaccgtaggtttgttcgatggagtcg

SEQ ID NO: 6563 - DNA, 31 bp, Artificial Sequence
  primer
aaaggtacccaggaaatgggagctaggaatc

SEQ ID NO: 6564 - DNA, 31 bp, Artificial Sequence
  primer
aaaggtaccctgatctgacctctgcaagtcc

SEQ ID NO: 6565 - DNA, 31 bp, Artificial Sequence
  primer
aaaggtaccagtcacaacctccaaaccagag

SEQ ID NO: 6566 - DNA, 34 bp, Artificial Sequence
  primer
aaaggtaccctacttctgaatctggaggagatcg

SEQ ID NO: 6567 - DNA, 34 bp, Artificial Sequence
  primer
aaagaattcctacccagagttgaagagcagagac

SEQ ID NO: 6568 - DNA, 31 bp, Artificial Sequence
  primer
aaaggtaccacagcatagcatcatcaaccag

SEQ ID NO: 6569 - DNA, 33 bp, Artificial Sequence
  primer
aaaggatccctaatcagcacggatacagattgc

SEQ ID NO: 6570 - DNA, 31 bp, Artificial Sequence
  primer
aaaggtaccactcaagctcggaatgtactgc

SEQ ID NO: 6571 - DNA, 31 bp, Artificial Sequence
  primer
aaaggtacccagttacaagcatgcactgtcc

SEQ ID NO: 6572 - DNA, 31 bp, Artificial Sequence
  primer
aaaggtaccgctactgtaaccaccacactcg

SEQ ID NO: 6573 - DNA, 31 bp, Artificial Sequence
  primer
aaaggtaccacgagcaaactagaaacgaagc

SEQ ID NO: 6574 - DNA, 34 bp, Artificial Sequence
  primer
aaagaattcctaagattcagagcagagcagtgac

SEQ ID NO: 6575 - DNA, 35 bp, Artificial Sequence
  primer
aaaggtaccctatatacaacacacgacgacaatgg

SEQ ID NO: 6576 - DNA, 31 bp, Artificial Sequence
  primer
tttgaattcttaatggagttgtcaagcagcg

SEQ ID NO: 6577 - DNA, 32 bp, Artificial Sequence
  primer
aaaggtaccacattacacgaaatggcacctac

SEQ ID NO: 6578 - DNA, 34 bp, Artificial Sequence
  primer
aaaggtaccctacagagacaacagtagcaccgac

SEQ ID NO: 6579 - DNA, 35 bp, Artificial Sequence
  primer
aaaggtaccctacgagaatagtttacatgccttcg

SEQ ID NO: 6580 - DNA, 34 bp, Artificial Sequence
  primer
aaaggtaccctactgccatctgatgtgtctgaac

SEQ ID NO: 6581 - DNA, 31 bp, Artificial Sequence
  primer
aaaggtaccgaggctacaagctaggctatgg

SEQ ID NO: 6582 - DNA, 31 bp, Artificial Sequence
  primer
aaaggtacctggagtttagcacagacgacac

SEQ ID NO: 6583 - DNA, 31 bp, Artificial Sequence
  primer
aaaggtaccgatcgaggctcagttattctgc

SEQ ID NO: 6584 - DNA, 34 bp, Artificial Sequence
  primer
aaaggtaccctacgatcgatcaatcaaccctaac

SEQ ID NO: 6585 - DNA, 31 bp, Artificial Sequence
  primer
aaaggtaccacagatcacacaagtgcctgag

SEQ ID NO: 6586 - DNA, 31 bp, Artificial Sequence
  primer
aaaaggcctgctagaagctatggctgattgg

SEQ ID NO: 6587 - DNA, 30 bp, Artificial Sequence
  primer
aaaggatccaattcagcaccaacaagcaag

SEQ ID NO: 6588 - DNA, 31 bp, Artificial Sequence
  primer
aaaggtaccgagccttggttcaaatcagaag

SEQ ID NO: 6589 - DNA, 31 bp, Artificial Sequence
  primer
aaaggatccggagaatgctaggtcagtggtc

SEQ ID NO: 6590 - DNA, 39 bp, Artificial Sequence
  primer
tttggtaccttatcaacaacttttgctaacttgtagaac

SEQ ID NO: 6591 - DNA, 31 bp, Artificial Sequence
  primer
aaagaattcaatacaacagaggctctccagc

SEQ ID NO: 6592 - DNA, 34 bp, Artificial Sequence
  primer
aaaggtaccctaagaagcattgtcaggatagagg

SEQ ID NO: 6593 - DNA, 32 bp, Artificial Sequence
  primer
aaagagctcacgatcgaaacaatatggaagac

SEQ ID NO: 6594 - DNA, 32 bp, Artificial Sequence
  primer
aaaggtacccatgcaactatatcacgcaagtc

SEQ ID NO: 6595 - DNA, 30 bp, Artificial Sequence
  primer
aaagaattcacgcaaacagaccacatgaac

SEQ ID NO: 6596 - DNA, 31 bp, Artificial Sequence
  primer
aaaggatccaaacctggtagcagacgctaaa

SEQ ID NO: 6597 - DNA, 31 bp, Artificial Sequence
  primer
aaaggtaccaaatcgactatgccaagtctgc

SEQ ID NO: 6598 - DNA, 32 bp, Artificial Sequence
  primer
aaaggtaccgaagaacttaaattgcctgctcc

SEQ ID NO: 6599 - DNA, 35 bp, Artificial Sequence
  primer
aaaggatccctacaaggttacgatgtgaaacaagg

SEQ ID NO: 6600 - DNA, 32 bp, Artificial Sequence
  primer
aaaaggccttcgactaattcaaattcacgctc

SEQ ID NO: 6601 - DNA, 31 bp, Artificial Sequence
  primer
aaaggtaccctcagtgaaagtccaaaccgtc

SEQ ID NO: 6602 - DNA, 30 bp, Artificial Sequence
  primer
aaaggtaccgccatcagcagcaacactaac

SEQ ID NO: 6603 - DNA, 34 bp, Artificial Sequence
  primer
aaaggtaccctaaatgagaaatggacgactcctg

SEQ ID NO: 6604 - DNA, 38 bp, Artificial Sequence
  primer
tttggtacccacacttgattagattctacacatgttac

SEQ ID NO: 6605 - DNA, 31 bp, Artificial Sequence
  primer
aaaggtaccaggaagaaagaatacacccacc

SEQ ID NO: 6606 - DNA, 31 bp, Artificial Sequence
  primer
aaaggtaccaatctctgcatcagttggaagg

SEQ ID NO: 6607 - DNA, 31 bp, Artificial Sequence
  primer
aaaggtaccaaagcagaaactgaaggccaac

SEQ ID NO: 6608 - DNA, 31 bp, Artificial Sequence
  primer
aaagatatccaaatgtttcttgatcccaagc

SEQ ID NO: 6609 - DNA, 31 bp, Artificial Sequence
  primer
aaaaggcctaaagatggttccttccctttcc

SEQ ID NO: 6610 - DNA, 36 bp, Artificial Sequence
  primer
aaagaattcttatgtagctctactgtttcacttggc

SEQ ID NO: 6611 - DNA, 32 bp, Artificial Sequence
  primer
aaaaggcctgcatttgcaatgtgttacagaac

SEQ ID NO: 6612 - DNA, 36 bp, Artificial Sequence
  primer
tttgaattcttactgcaccttcgtagatcagaactc

SEQ ID NO: 6613 - DNA, 30 bp, Artificial Sequence
  primer
aaaggatccagcttcatactcttccgacga

SEQ ID NO: 6614 - DNA, 32 bp, Artificial Sequence
  primer
aaaggatccctgggattacgcaaatatcaaag

SEQ ID NO: 6615 - DNA, 31 bp, Artificial Sequence
  primer
aaaggatccagcctgtcaacagacatcttta

SEQ ID NO: 6616 - DNA, 31 bp, Artificial Sequence
  primer
aaaggatcctcagaagctcagaactaccacg

SEQ ID NO: 6617 - DNA, 31 bp, Artificial Sequence
  primer
aaaggatcccagtcaccgacactctcctagc

SEQ ID NO: 6618 - DNA, 28 bp, Artificial Sequence
  primer
aaaggatccaacgccatcttgtgtgacg

SEQ ID NO: 6619 - DNA, 28 bp, Artificial Sequence
  primer
aaaggatcctgctttagccgtctccgac

SEQ ID NO: 6620 - DNA, 30 bp, Artificial Sequence
  primer
aaaggatcccaaccaccacacagagaggag

SEQ ID NO: 6621 - DNA, 31 bp, Artificial Sequence
  primer
aaaggatccgggcgaatctcttcagtatgag

SEQ ID NO: 6622 - DNA, 30 bp, Artificial Sequence
  primer
aaagtcgacgcagttgtaaccaagtggcag

SEQ ID NO: 6623 - DNA, 31 bp, Artificial Sequence
  primer
aaaggatccgcaagagtgcgtccatataagc

SEQ ID NO: 6624 - DNA, 28 bp, Artificial Sequence
  primer
aaaggatcccgtcttctctgaccccgag

SEQ ID NO: 6625 - DNA, 29 bp, Artificial Sequence
  primer
aaaggatcccagcggatcattacccaatc

SEQ ID NO: 6626 - DNA, 31 bp, Artificial Sequence
  primer
aaactcgagcgaaggtttctttaatcccgtg

SEQ ID NO: 6627 - DNA, 29 bp, Artificial Sequence
  primer
aaagtcgacgctccgccaatataaccctc

SEQ ID NO: 6628 - DNA, 31 bp, Artificial Sequence
  primer
aaagtcgactctcgattcttccaaagggttc

SEQ ID NO: 6629 - DNA, 31 bp, Artificial Sequence
  primer
aaaggatcctagtcattccaccatccctttg

SEQ ID NO: 6630 - DNA, 29 bp, Artificial Sequence
  primer
aaagaattccacaagctatccagtcacgc

SEQ ID NO: 6631 - DNA, 31 bp, Artificial Sequence
  primer
aaaggatcccggccatagaaaggagataagg

SEQ ID NO: 6632 - DNA, 31 bp, Artificial Sequence
  primer
aaaggatcctaaccatcacactggctgactc

SEQ ID NO: 6633 - DNA, 27 bp, Artificial Sequence
  primer
aaaggatccctcggctaggcctcgaat

SEQ ID NO: 6634 - DNA, 33 bp, Artificial Sequence
  primer
aaaggatccgaagttggcactcagaaatcctac

SEQ ID NO: 6635 - DNA, 29 bp, Artificial Sequence
  primer
aaagtcgacaacctggagtcccagtcaac

SEQ ID NO: 6636 - DNA, 27 bp, Artificial Sequence
  primer
aaaggatccaagcatcgcaccagatcg

SEQ ID NO: 6637 - DNA, 30 bp, Artificial Sequence
  primer
aaactcgagtctctctcgacaggctgacac

SEQ ID NO: 6638 - DNA, 30 bp, Artificial Sequence
  primer
aaaggatccgtccgcctataacaccaccac

SEQ ID NO: 6639 - DNA, 30 bp, Artificial Sequence
  primer
aaaggatcccagtcgtcagtcgcctacttc

SEQ ID NO: 6640 - DNA, 26 bp, Artificial Sequence
  primer
aaaggatccttggactggaagcgacc

SEQ ID NO: 6641 - DNA, 27 bp, Artificial Sequence
  primer
aaagtcgacctccgatcccaaggttgg

SEQ ID NO: 6642 - DNA, 30 bp, Artificial Sequence
  primer
aaaggatccagatcgtgcctactccctctc

SEQ ID NO: 6643 - DNA, 31 bp, Artificial Sequence
  primer
aaagtcgacgatctggttctcctcgtgtgtc

SEQ ID NO: 6644 - DNA, 26 bp, Artificial Sequence
  primer
aaaggatccgagccgcaccatcccag

SEQ ID NO: 6645 - DNA, 27 bp, Artificial Sequence
  primer
aaagtcgacctcactccccggaaaatg

SEQ ID NO: 6646 - DNA, 31 bp, Artificial Sequence
  primer
aaaggatcctcttatcatctcctcccgtgtg

SEQ ID NO: 6647 - DNA, 29 bp, Artificial Sequence
  primer
aaaggatccagccacaagccctcttcttc

SEQ ID NO: 6648 - DNA, 27 bp, Artificial Sequence
  primer
aaaggatcccatcgatctcgcgctctc

SEQ ID NO: 6649 - DNA, 37 bp, Artificial Sequence
  primer
aaaggatcccccatatgcctcaggtcaagtctactgc

SEQ ID NO: 6650 - DNA, 32 bp, Artificial Sequence
  primer
aaaggatccgaactcgacagggagttcttagg

SEQ ID NO: 6651 - DNA, 27 bp, Artificial Sequence
  primer
aaagtcgacgctccgtctcgtcaatcc

SEQ ID NO: 6652 - DNA, 29 bp, Artificial Sequence
  primer
aaagtcgacggagaggaggccatcaaatc

SEQ ID NO: 6653 - DNA, 31 bp, Artificial Sequence
  primer
aaaggatccctgtgatcgagttcctcttgtg

SEQ ID NO: 6654 - DNA, 31 bp, Artificial Sequence
  primer
aaaggatccaagcaacttctcgcacgtagtc

SEQ ID NO: 6655 - DNA, 28 bp, Artificial Sequence
  primer
aaaggatcccgcgatctgtaacgtgtgg

SEQ ID NO: 6656 - DNA, 32 bp, Artificial Sequence
  primer
aaagtcgaccgggaagagattgggtactgtag

SEQ ID NO: 6657 - DNA, 29 bp, Artificial Sequence
  primer
aaaggatccggcatttgctacaccaccac

SEQ ID NO: 6658 - DNA, 30 bp, Artificial Sequence
  primer
aaaggatcccatttctcaaaaagcccaaac

SEQ ID NO: 6659 - DNA, 29 bp, Artificial Sequence
  primer
aaagtcgacctcagctccactgacgaaag

SEQ ID NO: 6660 - DNA, 34 bp, Artificial Sequence
  primer
aaaggatccatatagaatgggttgggaattatgc

SEQ ID NO: 6661 - DNA, 28 bp, Artificial Sequence
  primer
aaaggatccgctcctcgccatctttagc

SEQ ID NO: 6662 - DNA, 29 bp, Artificial Sequence
  primer
aaaggatcctacctgcctctgctctgctc

SEQ ID NO: 6663 - DNA, 31 bp, Artificial Sequence
  primer
aaaggatccatggtgagtctctctcagcagc

SEQ ID NO: 6664 - DNA, 31 bp, Artificial Sequence
  primer
aaaggatccaaactctcgtctctggtcatcc

SEQ ID NO: 6665 - DNA, 29 bp, Artificial Sequence
  primer
aaactcgaggcaagtgagccatcactgag

SEQ ID NO: 6666 - DNA, 30 bp, Artificial Sequence
  primer
aaagtcgacatccagcaaggaaggaggaag

SEQ ID NO: 6667 - DNA, 31 bp, Artificial Sequence
  primer
aaaggatccgcctaccgttccttcttctacc

SEQ ID NO: 6668 - DNA, 32 bp, Artificial Sequence
  primer
aaacccgggggcacaagcaagagaaggattag

SEQ ID NO: 6669 - DNA, 31 bp, Artificial Sequence
  primer
aaaggatccaaatacctgccttcctttctgg

SEQ ID NO: 6670 - DNA, 32 bp, Artificial Sequence
  primer
tttggatccgaatcaccttcccttcctattcc

SEQ ID NO: 6671 - DNA, 29 bp, Artificial Sequence
  primer
aaaggatccaggtccgacaccacacaaac

SEQ ID NO: 6672 - DNA, 31 bp, Artificial Sequence
  primer
aaagtcgacaaagccattccttcaatcactc

SEQ ID NO: 6673 - DNA, 30 bp, Artificial Sequence
  primer
aaaggatccaagtgggagccaagtcatctc

SEQ ID NO: 6674 - DNA, 31 bp, Artificial Sequence
  primer
aaaggatcccaagatccatcttcccggttac

SEQ ID NO: 6675 - DNA, 31 bp, Artificial Sequence
  primer
aaaggatccatccatccacttactacgctgc

SEQ ID NO: 6676 - DNA, 31 bp, Artificial Sequence
  primer
aaagtcgacctgggaagaaacatttcactgc

SEQ ID NO: 6677 - DNA, 27 bp, Artificial Sequence
  primer
aaaggatccggctagcaagtgcatgca

SEQ ID NO: 6678 - DNA, 29 bp, Artificial Sequence
  primer
aaacccgggcaaacgcattccatcctctc

SEQ ID NO: 6679 - DNA, 31 bp, Artificial Sequence
  primer
aaaggatcctgaccatcgtctcactcatctc

SEQ ID NO: 6680 - DNA, 31 bp, Artificial Sequence
  primer
aaagtcgaccatttgagatattccctcgctc

SEQ ID NO: 6681 - DNA, 31 bp, Artificial Sequence
  primer
aaaggatccctacatgctctccatccaatcc

SEQ ID NO: 6682 - DNA, 27 bp, Artificial Sequence
  primer
aaaggatccaaagttgcagcggcagtg

SEQ ID NO: 6683 - DNA, 27 bp, Artificial Sequence
  primer
aaaggatccaccgagccatagccacag

SEQ ID NO: 6684 - DNA, 29 bp, Artificial Sequence
  primer
aaaggatccccctctatatcctcccgcac

SEQ ID NO: 6685 - DNA, 29 bp, Artificial Sequence
  primer
aaagtcgacagcagttcttctttgcggtg

SEQ ID NO: 6686 - DNA, 31 bp, Artificial Sequence
  primer
aaaggatccgtcctcggtcgctatttctctc

SEQ ID NO: 6687 - DNA, 27 bp, Artificial Sequence
  primer
aaaggatccacgcctccgctttcattc

SEQ ID NO: 6688 - DNA, 31 bp, Artificial Sequence
  primer
aaaggatccgacatatggacacaggcagttg

SEQ ID NO: 6689 - DNA, 27 bp, Artificial Sequence
  primer
aaaggatcccatcatcacaagccgcag

SEQ ID NO: 6690 - DNA, 31 bp, Artificial Sequence
  primer
aaaggatcccaaccaatttcctctaccctcc

SEQ ID NO: 6691 - DNA, 36 bp, Artificial Sequence
  primer
aaaggatccccactgtacagggtagtagatctttcg

SEQ ID NO: 6692 - DNA, 29 bp, Artificial Sequence
  primer
aaaggatccagattctgacaacgccttcc

SEQ ID NO: 6693 - DNA, 28 bp, Artificial Sequence
  primer
aaagtcgacaaaccctcgttctcgttcc

SEQ ID NO: 6694 - DNA, 31 bp, Artificial Sequence
  primer
aaaggatccgaccatcatgtacaatcgcaac

SEQ ID NO: 6695 - DNA, 31 bp, Artificial Sequence
  primer
aaagtcgacctgccattacatataccgcacc

SEQ ID NO: 6696 - DNA, 31 bp, Artificial Sequence
  primer
aaggatccactcaagggtcagaggttgtacc

SEQ ID NO: 6697 - DNA, 31 bp, Artificial Sequence
  primer
aaaggatccgcttcaacaagaggacaagagg

SEQ ID NO: 6698 - DNA, 29 bp, Artificial Sequence
  primer
aaaggatccgaatcaggtcggttgctctc

SEQ ID NO: 6699 - DNA, 29 bp, Artificial Sequence
  primer
aaagtcgacttagaagctgctgccagagg

SEQ ID NO: 6700 - DNA, 30 bp, Artificial Sequence
  primer
aaaggatccgagtagcagcttcttgcgagg

SEQ ID NO: 6701 - DNA, 31 bp, Artificial Sequence
  primer
aaaggatcctcctctgtatttaaaggccacc

SEQ ID NO: 6702 - DNA, 32 bp, Artificial Sequence
  primer
aaagtcgacactcctaatcagcgcttaatcag

SEQ ID NO: 6703 - DNA, 30 bp, Artificial Sequence
  primer
aagtcgacagacagatagcagaacacacgc

SEQ ID NO: 6704 - DNA, 26 bp, Artificial Sequence
  primer
aaagtcgacgagctgccaaaaacggg

SEQ ID NO: 6705 - DNA, 31 bp, Artificial Sequence
  primer
aaaggatccctttcccatatccaaccacctc

SEQ ID NO: 6706 - DNA, 30 bp, Artificial Sequence
  primer
aaaggatccaacaagctcgacgacacaaag

SEQ ID NO: 6707 - DNA, 28 bp, Artificial Sequence
  primer
aaaggatcccacagcaaccaaggcaaac

SEQ ID NO: 6708 - DNA, 32 bp, Artificial Sequence
  primer
aaaggatcccggagagggccaatagaataaag

SEQ ID NO: 6709 - DNA, 30 bp, Artificial Sequence
  primer
aaagaattcgcaacctcaaggagaaggaag

SEQ ID NO: 6710 - DNA, 31 bp, Artificial Sequence
  primer
aaaggatcccttggttacaggttactgcgtg

SEQ ID NO: 6711 - DNA, 27 bp, Artificial Sequence
  primer
aaaggatcccttgcgcgtcgataaacc

SEQ ID NO: 6712 - DNA, 31 bp, Artificial Sequence
  primer
aaaggatccgcgccatcacatactgacatac

SEQ ID NO: 6713 - DNA, 31 bp, Artificial Sequence
  primer
aaagatatccggtactgatcacactcctacg

SEQ ID NO: 6714 - DNA, 29 bp, Artificial Sequence
  primer
aaaggatccggcgctataccaaccatgag

SEQ ID NO: 6715 - DNA, 30 bp, Artificial Sequence
  primer
aaaggatccagaaacctccatccagtcgag

SEQ ID NO: 6716 - DNA, 31 bp, Artificial Sequence
  primer
aaagtcgactatcctcttgctctgttcgtcc

SEQ ID NO: 6717 - DNA, 31 bp, Artificial Sequence
  primer
aaaggatccatctcgtgtaggctctccactc

SEQ ID NO: 6718 - DNA, 27 bp, Artificial Sequence
  primer
aaaggatccgaaaggcaaggcctcctc

SEQ ID NO: 6719 - DNA, 33 bp, Artificial Sequence
  primer
aaaggatcccagagctatcagcattcaacactc

SEQ ID NO: 6720 - DNA, 31 bp, Artificial Sequence
  primer
aaaggatcccaagcaggaacactcacctagc

SEQ ID NO: 6721 - DNA, 31 bp, Artificial Sequence
  primer
aaaggatccgtatattcccgtcccaatctcc

SEQ ID NO: 6722 - DNA, 30 bp, Artificial Sequence
  primer
aaaggatccgttgctgagctaatcgagctg

SEQ ID NO: 6723 - DNA, 28 bp, Artificial Sequence
  primer
aaaggatcccaatcaccaatctcgcctc

SEQ ID NO: 6724 - DNA, 30 bp, Artificial Sequence
  primer
aaaggatcccggtgaagactggaatctgag

SEQ ID NO: 6725 - DNA, 31 bp, Artificial Sequence
  primer
aaaggatccaccttgctctcctgactagcac

SEQ ID NO: 6726 - DNA, 28 bp, Artificial Sequence
  primer
aaaggatccgcatttcctcgtttccagc

SEQ ID NO: 6727 - DNA, 34 bp, Artificial Sequence
  primer
aaaggatcctcagctactactcctagctcccaac

SEQ ID NO: 6728 - DNA, 27 bp, Artificial Sequence
  primer
aaaggatccctgacggctgcacctacc

SEQ ID NO: 6729 - DNA, 28 bp, Artificial Sequence
  primer
aaggatccacgagctagggaggagacag

SEQ ID NO: 6730 - DNA, 28 bp, Artificial Sequence
  primer
aaggatccatggaacagagacaggcagg

SEQ ID NO: 6731 - DNA, 31 bp, Artificial Sequence
  primer
aaaggatcctagtctctcgatcgatcaccac

SEQ ID NO: 6732 - DNA, 31 bp, Artificial Sequence
  primer
aaaggatccctgtgtcggagagactcatcac

SEQ ID NO: 6733 - DNA, 30 bp, Artificial Sequence
  primer
aaaggatccaatccaaatgggacggtagag

SEQ ID NO: 6734 - DNA, 33 bp, Artificial Sequence
  primer
aaaggatcccatttcaacctctcttccctaacc

SEQ ID NO: 6735 - DNA, 30 bp, Artificial Sequence
  primer
aaagtcgacagcactggttgttggtaggtg

SEQ ID NO: 6736 - DNA, 31 bp, Artificial Sequence
  primer
aaagtcgaccattaatacagcaaggcagcac

SEQ ID NO: 6737 - DNA, 33 bp, Artificial Sequence
  primer
aaaggatccaaagtggaagacagaagatgaagc

SEQ ID NO: 6738 - DNA, 34 bp, Artificial Sequence
  primer
aaagtcgactctaacagagaggagaagagagtgc

SEQ ID NO: 6739 - DNA, 34 bp, Artificial Sequence
  primer
aaaggatccattgacctcgaactctgaacttagg

SEQ ID NO: 6740 - DNA, 34 bp, Artificial Sequence
  primer
aaagtcgacttgtttccttggaatttatcagttg

SEQ ID NO: 6741 - DNA, 30 bp, Artificial Sequence
  primer
aaaggatccctctctttcacacaaacccag

SEQ ID NO: 6742 - DNA, 34 bp, Artificial Sequence
  primer
aaaaggccttgttctctatctagtccaaacccag

SEQ ID NO: 6743 - DNA, 36 bp, Artificial Sequence
  primer
aaaggatcctcaaatttggaatagttgaagaagaag

SEQ ID NO: 6744 - DNA, 31 bp, Artificial Sequence
  primer
aaagatatctactgaagaagttgggttggtg

SEQ ID NO: 6745 - DNA, 32 bp, Artificial Sequence
  primer
aaagtcgaccacattattcaaacaacatggca

SEQ ID NO: 6746 - DNA, 32 bp, Artificial Sequence
  primer
aaaggatcctcatcaacaaacaaacagcaatc

SEQ ID NO: 6747 - DNA, 31 bp, Artificial Sequence
  primer
aaagtcgactaaggaggagagctccaatctc

SEQ ID NO: 6748 - DNA, 32 bp, Artificial Sequence
  primer
aaagtcgacgaaattcttggctctcctctttg

SEQ ID NO: 6749 - DNA, 31 bp, Artificial Sequence
  primer
aaagtcgactgcgcatttctaacggataaag

SEQ ID NO: 6750 - DNA, 35 bp, Artificial Sequence
  primer
aaaggatcctgtgcttccctatcttcttcttctac

SEQ ID NO: 6751 - DNA, 31 bp, Artificial Sequence
  primer
aaaggatccgcttcattcttcacagatcagg

SEQ ID NO: 6752 - DNA, 29 bp, Artificial Sequence
  primer
aaaggatccttatttctcaccgccaaacc

SEQ ID NO: 6753 - DNA, 29 bp, Artificial Sequence
  primer
aaaggatccagaagggtccattccatttc

SEQ ID NO: 6754 - DNA, 33 bp, Artificial Sequence
  primer
aaaggatccgtaagcttatctctgttgctgtgg

SEQ ID NO: 6755 - DNA, 31 bp, Artificial Sequence
  primer
aaaggatcccgggtcctaacctatgaatgtc

SEQ ID NO: 6756 - DNA, 31 bp, Artificial Sequence
  primer
aaaggatccagctccatagccaaactccttc

SEQ ID NO: 6757 - DNA, 27 bp, Artificial Sequence
  primer
aaaggatccatctccgtcgatccacca

SEQ ID NO: 6758 - DNA, 31 bp, Artificial Sequence
  primer
aaagtcgactcttcatctcgattcccatacg

SEQ ID NO: 6759 - DNA, 30 bp, Artificial Sequence
  primer
aaagaattcacctcacctcatcgcagtttc

SEQ ID NO: 6760 - DNA, 28 bp, Artificial Sequence
  primer
aaagatatcacaggactctcgccatcag

SEQ ID NO: 6761 - DNA, 31 bp, Artificial Sequence
  primer
aaagaattcctccaaacaccaagaaatccac

SEQ ID NO: 6762 - DNA, 30 bp, Artificial Sequence
  primer
aaactcgagctcgtctctcgtcccaatttc
